United States Patent 10,279,031 (COMPOSITION COMPRISING ANTIGENS AND A MUCOSAL ADJUVANT AND A METHOD FOR USING) - sequence listing, part 2

SEQ ID NO: 2 - DNA, 2095898 bp, Streptococcus suis
atgaaccaagaacaacttttttggcaacgatttattgaattggcaaaggtaaattttaagccatctatttatgatttttatgtcgctgatgcaaaattactcggaatcaaccagcaagttgccaatattttcttaaatcgtccatttaaaaaagatttctgggaaaaaaacttcgaagagttaatgattgccgctagttttgaaagctacggagagcctcttaccatccaatatcaatttacagaggatgaacaggagattaggaatactacaaacacaagaagttcaatagttcaccaggtacagacacttgagccggctactcctcaagaaacttttaaaccggttcattctgatataaaatcccagtacacctttgctaattttgtacaaggagacaataatcactgggcaaaggctgcagctttagctgtatctgataacctaggtgagctctacaatccattattcatttttggtggtcctggtcttggaaaaactcatattttaaatgcgattggaaataaggttctagccgataatccccaggcaaggataaaatatgtctcatcggaaacattcatcaatgaatttttagaacacctccgtctcaatgatatggaaagtttcaaaaaaacctatcgcaatctggacttacttctaattgatgacattcagtctctccgtaataaagcaacaacacaggaagaatttttccatacttttaatgcgcttcatgaaaaaaataagcagattgtactcacaagcgaccgtaatcccgatcacttagacaatttggaagaaagactagtaacacgtttcaaatgggggttaaccagtgaaatcactccacctgattttgaaacacgtatcgcaattttacgtaacaagtgcgagaacctgccttacaactttacaaatgagacgctatcctatctagctgggcaatttgattcgaacgtacgtgaccttgaaggtgccttaaaagatatccatttgatagccactatgcgtcaactgtctgagataagtgtcgaggttgctgctgaggctattcgatcaagaaaacaaacaaatccacaaaacatggttattcctattgagaaaatccaaaccgaagtgggaaatttctacggtgtcagcttgaaagaattaaaaggttctaagcgtgttcaacatatcgttcacgcgcgacaagttgctatgtttttagcacgtgaaatgacagacaattcccttccaaaaattgggaaagaatttggtaatcgagaccatacaaccgttatgcatgcatacaataaaataaaaactctcctcttggatgatgagaatttagaaatagagattaccagtataaaaaataaacttcgttaacctgtgtataacttttttaaaaaactctgttttttccacaagttgtgaacaagttaatttccgcagttttattggtctttcatcacttttccacagaatacacagagactactattactattaaccttatagataataaataaaggagaatccatgattcaattttctattaataaaaatatatttctacaagcacttagtattactaaacgggcaatcagtacaaaaaatgctattccaattctttcaacagtaaaaattacagtaactagtgaaggaatcactttaactggttcaaatggacaaatctcgatagaacattttatttctattcaagatgaaaatgcagggcttttgatcagttctccaggttccattctcttagaagctggtttctttattaatgtcgtatccagtatgccggatttggtccttgacttcaatgaaattgaacaaaagcaaatcgttttgacaagtggtaagtctgaaatcacattaaagggaaaagaagcagaacagtatcctcgtttacaggaagttccaacttcaaaaccattggtgttagaaaccaaagtattaaaacaaacaattaatgaaacagcatttgcagcttctacacaagaaagtcgtcctattcttacgggtgttcattttgttttaacagaaaataaaaatctaaaaactgttgcaacagattcacaccgtatgagccaacggaaattggtccttgatacctctggtgatgattttaatgttgtcattccaagtcgttctctccgtgaatttactgcagtttttacagatgatattgaaacagtagaagtcttcttttcaaataatcaaatcctttttagaagcgagcatattagcttctatacacgcttattagaaggtacctaccctgataccgaccgcttaattccaactgagtttaaaacaactgcaatttttgatactgcaaatcttcgtcactcgatggagcgtgctcgtcttctttcaaatgcaacccaaaatggtacagtaaaactagaaattgctaataatgttgtatcggctcatgtaaattctccagaagttggacgtgtgaatgaggaattagatactgtagaagtatcaggtgaagatttagtaatcagctttaacccaacttacttgatagaagcattgaaagccacaactagtgaacaagtgaaaattagctttatctcttctgtccgtccatttacattgattccaaataatgaaggggaagattttattcaattggttacaccagttcgtaccaactaaataatattaagaacggctaaactagccgtttttatgttatactaaaaaatagcacctagcttatttttatatatttagtgatggggaataaatgacgttatatatattagctaatcctaatgctggtagccatactgctgaacatatcatattcaaaataaaagaaagttatccacagcttgcagttaacatttttatgacagttggtcctgaggatgaaaaaagtcaaatagaggctattttaaaggagtttgtcagtagtgaagatcaattaatgattttaggcggagacggcacactatctaaagctttgcgtttttggccagctagtctaccgtttgcttattatccaacaggatctggaaatgattttgctaaggcaatgaatataacatcgctatatagaagtgtagatgccattttagagagaaaaacaagtcggatatatgttttaaacagttcatacggaacggttgtaaacagtatggattttggctttgcagctcaagttatcaatggttcaacgaattcaattttgaaaaaaattctgaacaaggtaaaacttgggaagttaacttatctattctttggtattaaaacattattttcaaaacaagctataaacttagaattaactcttgatgaaaaatcttatcagttagataatctcttttttatttctgtagcaaatagtctttattttggtggaggaatcatgatatggccaacagcaagtgctaaaaagaaggaagtagatattgtttacttcaaaaatggaaatttctaccaacgtctacaatcattgttagccttattaacgaagaggcatgaatcttctcatacgattcagcatttaacaggggtagatgtagttttaaaatcaaaagaaaaattattattgcaaatagatggagagacatgcactgcaaatgaggtaacgttaacctatcaggaaagaagtatgtatctttaaggaggaagtatgtaccaattaggaacctttgtcgaaatgaaaaagccccatgcctgtgtcatcaaatcgaccggaaagaaggctaataaatgggaggttatccgtctaggagcggatattaaaatccgctgtaccaactgtgaccatgtcgttatgatgagccggcatgattttgaacgaaaaatgaaacaagttctgccaagtgaagcctagttgacagtttgcaactactggttgcgaatttttcctaaaaagtgctagtcaactgttcctttctaaactataatagacttagaaaaaagaggaggaaatgatcatgaagcagttagcacagcaaattcgagttttacgcacagccaagaacctatcccaagatgagttggcagagaaactctatatttcccgtcaggctgtttccaagtgggaaaatggtgaagccacaccagatattgacaaactggtccagctggcagaaatctttggtgtcagtctggattatctggttttagggaaagaacctgagaaggaaattgtggtggaacaacgaggaaaaatgaatggttgggaattcttgaacgaagaatccaaacgacctcttacaagaggagatgttgtccttctcatttttcttgcagttatgcttttaggtggattatttattaagcattatttttaacgaagcttgccaaacagcaagctttttctctacttttctgctataatagtcatgattgaatttttaattggagagtaaaaaaaacatgtctttaacagcaggaatcgtcggtttgccaaacgttggtaaatcaaccctatttaacgcaattaccaaggcaggagcagaagctgcaaactaccctttcgcaactattgatccaaacgtcggcatggtagaagtgcccgatgagcgtctgcagaagttgaccgaactcatcatccctaaaaagacagtgccaacgacttttgaatttactgatattgctggtatcgtaaaaggtgcttctaaaggtgaaggacttggaaataaattcttggccaatatccgcgaagttgatgcgattgtccacgttgtgcgtgcctttgacgatgaaaatgtcatgcgtgaacaaggccgtgaagatgcctttgtggatccaatcgctgatattgataccattaacctagaattgattttggcggacctagagagcatcaacaagcgttatgcgcgtgtagaaaaaatggcccgtacgcaaaaagacaaagattctgtcgcagaatttgcagttcttgaaaaaatcaaacctgtcctagaagacggaaaatctgcccgcacagttgagttcacagatgaagaacaaaaaatcgttaagcaactcttcctcttgaccactaaacccgtcctctatgttgccaatgttgatgaagacaaggtagcagatcctgaggctatcagttatgttcagcaaatccgtgactttgcagcaacagaaaatgcagaagtggtggtgatctctgcgcgtgctgaagaagaaatttcagaactcgacgatgaagacaagggcgagtttttagaagcactcggattaacagaatctggcgtggacaaattaacacgtgcagcctatcacttgcttggtctaggcacctactttacagcaggggagaaggaggttcgtgcttggaccttcaaacgtggtatgaaagctcctcagtgtgcaggcattatccattcagacttcgaaaaaggttttatccgtgccgttaccatgtcatacgatgatttaatgacctacggctctgagaaggctgttaaagaagcaggacgccttcgtgaagaaggaaaagagtacgtggttcaagatggggacatcatggagttccgctttaacgtttgattgctaaactgtccttattcttcgttgttttaccttgccataccatcagtattgtctgcggtttcaacgcctagactaagaacagtttatcgcatcaaagaggatgattacttggttggaaagctttttccagccttttggtatttaaggagaaaaaatgacacgattgattatcggtttgggaaatcccggagaccgctattttgaaacaaaacataacgttggttttatgctgctggataagattgctaagcgtgaaaatgtgacctttaaccacgataagattttccaagcagacattgccacaacctttattgatggtgaaaaaatttacctggtcaaaccaacgactttcatgaatgaatcaggtaaggctgtccatgccttaatgacttattatggtctggatgcaactgatattttagtagcttatgacgacttggacatggctgttggaaaaatccgtttccgtcaaaaaggctcagctggtggccacaatggtatcaaatccattgtcaagcatattggaacacaggaatttgaccgtatcaagattggtattgggcgtcctaaaggaaaaatgagcgttgtaaaccatgtcttgtctggctttgatatagaggaccgtattgaaatcgacttagcactagataaacttgacaaggctgtcaacgtatatctcgaagaagatgattttgatacagtaatgagaaagtttaacggataatgaatatactcgatttacttcacaagaacaagcaaatcaatcaatggcagtcaggattgaatcaatcaacacgtcagttattattaggactatctgggactagtaagtcacttataatggcgactgcctatgattgtttggccgaaaagattatgattgtgactgccactcaaaatgatgctgagaaattagttgcagatttaacagccattattggaagtgagaatgtttacaacttttttacagatgatagtcctattgccgagtttgtttttgcatcaaaagaacggactcaatcaaggattgacagtttaaatttcttgacagattctaccagttcaggaattttagttgctagtatagttgcttgtcgggtcttattgccgagtcctgagacttataaaggttctaaaatacagcttgaagttggtcaagaaatagaagttgacaaacttgtaaagaaccttgtcaacatcggctacaaaaaagtgtctcgtgtattaacccagggagaatttagccaacgaggtgatattctagatatttttgacatgcaatcagaaacaccttaccgaatagaattttttggagatgagattgatggcattcgtatctttgatgttgacagtcaaaaatccttagaaaatctagacgaaatctcgatctctccagcttccgatatcattttgtcttcagaagactatagtagagctagccaatacattcagacagctattgaacaatcgactctagaggagcaacagtcttacttacgagaagtcttagctgatatgcagacggagtaccggcatccagatttgcgtaaattcttgtcctgtatctatgaacaatcatggacattgttggattacttgccaaagagttctcccttatttttggatgattttcataaaatcgctgataagcaggctcaatttgaaaaagaaattgcagacttgttgacagatgatttacagaagggtaaaacagtgtcaagtttgaaatattttgcctcaacttatgctgaattgagaaaatacaaacctgccaccttcttttcaagttttcaaaaaggtttaggaaatgtaaagtttgatgctctttatcaattcacacagcatcctatgcaggaatttttccaccagattccactgttaaaagatgaattgactcggtatgcgaaatcaaacaataccgttgttattcaagcgagttctgatgtaagtttacagactttacagaaaaatttacaagagtatgatatccatcttccagtacatgcagcagataagttagtagaaggtcagcaacaggttacgattggtcagttagcttcaggttttcatttgatggatgagaaactagttttcatcactgaaaaagagattttcaataagaaaatgaagcgtaagacacgtagaaccaatatttctaacgctgaacgtattaaggactatagtgaattagcagttggtgactatgttgttcaccatgttcatggtatcggtcaatacttaggaattgagactattgaaatttcaggcattcatcgtgattatttaacggttcaatatcaaaactccgatcgcatttctattcctgtagaacaaattgatcttctctccaaatacttagcgtccgatgggaaagctccaaaagttaataaactaaacgatggccggttccaacgaaccaagcaaaaagttcagaagcaagtggaggatattgcagatgatttgattaagctttatgcggagcgtagtcagctgaaaggctttgccttttcacctgatgatgaaaatcaagttgaatttgacaactactttacacacgtggaaaccgatgaccaactccgttccattgatgaaatcaaaaaagacatggaaaaagactctccaatggaccgtctgttagtaggagatgtcggatttggtaagacagaggtagccatgcgcgctgctttcaaagcagtcaatgatggcaagcaagtagctattcttgtacctacgactgttttagcccagcaacactatgctaatttccaagaacggtttgcagaatttcccgtcaatgtggatgttatgagtcgttttaaaacaaaggcagagcaggaaaaaacacttgagaagttgaaaaaaggccaagttgacatcttgattggtacccatcgccttctatcaaaagatgttgtttttgctgatttaggtttactggttattgacgaagagcaacggtttggtgtcaagcataaggaacgcttgaaggaactgaaaaagaaaatagatgtcctaaccttgactgcaactccgattcctcggacattgcaaatgtccatgctgggaatccgcgacttatcagtaattgagactccaccgacaaatcgctatcctgtacaaacttatgtgatggaaacaaatccttccgttatccgagatgcaatgcttcgagagatagatcgcggaggtcaggtttactatctttacaataaagttgataccattgaacagaaagtgtctgaattaaaagaattggttccagaagctactataggatacgtccatggacaaatgtcggagatccaattagaaaatactctctatgcttttgtagagggtgaatatgatattctagtgaccacaacaatcatcgaaacaggtgttgatattccaaatgctaatacactgtttattgaaaatgcagatcatatgggactgtcaactctttatcaacttagaggacgtgttggccgttccagtcggattgcctatgcctatctcatgtaccgtccagacaagtccttgacagaagtagctgaaaaacgtttggaggcaatcaagggctttacagaactaggatcaggtttcaagattgccatgcaagatttgtccattcgtggtgcgggaaatattttaggtgctgctcagtcaggttttattgattctgtgggatatgagatgtattcacaattgctggaacaagctatcttggaaaaacaaggtaaggcaacccaacgtcagaagagtaattccgaggtcaatttacagattgatgcctatttaccaagtgattatattggtgatcagcgacaaaaaattgaaatttacaagcgtataaagaatattgacagtcgtgtcaactatcaagaattgcaagaagaattgattgaccgttttggagagtatcctgatgtagtagcctacttgcttgaaatcggtctactgaagtcatttttagaccaagttttctgtcatacagttcttagacgacaacatcaagtgacagtaacattcgaacctatggctggtcaaattttcctaacgcaagattactttgaagctttatctgtgacaaatttgaaagctcagataacggaaaataaaggaaaactagctgttgtgtttaacattcaacagaaaaaagaatatgaaatattagaggaattgatttcttttgccgaaaaattaaaagaaattaaagcaaggaaggcagaataaatttctcaaataccttgaaaaatggtaaaataatgaactgaggtaaagtatgagactagataaatatttgaaagtatcccgcattatcaagcgtcgaacagttgcgaaggaagttgccgataaaggacgaataaaagtcaatgggattttggcgaaatcttcaacagatttaaaagtaaatgatcaggttgaaatccaatttggtaataaactactcactgtaaaagtacttgaaatgaaagattcgactaaaaaagaagacgcactgaaaatgtatgaaattatcagtgaaaaaaggatagaaaaagatgaagaaatctaaaattctacaactgaataatgcctttattcagtcggagcgtaaaaaaactcagcatcaattggcagaacgccaacaaaaaaatcgttttatgggtgcaattctcattctagttatctttctttttatgttgcctgcctataatcttgttgggacttacactaatattcagcagcaggaaaagaaacttgctgaattggaaaaaaattacgaagaactgaccaaagaacagaagcaggaagcagagatggttgcaaaattgaaaaatgaggaatacgcagcaaagtatgttcgggctaagtatcaatactctaaagaaggggaatttgtctacaatattccagggttaccaaaatgaccgaatctatttttaaaattgtagagcaatttttacagcattctgatgaaaaattagaagagttgaatcaaaagaatagagaattaaagttagaagaaaatgaatcgtagaaaggagggagtatgcagaaaaaactgctcgtatggttattgccagttttatttggatggcaggtggtcgatagtacagaaataccatttgaactcacagcgcaagaagaatacgaattgactcatactatctatgatcagtattttcaaactatccctcaaaacccaaatgtttttcaaactgagaatctttattcggatgaagaattgactatagcaggtggacaattacagccgaaccaacatttttctattacggatgttctagtcaatagcaaaaaagaattggttttccaaatagatgacaagggttacattcttgcaagtaggcatctactatttgatgatgtaattgttacagaaactactgttgagcaaacttattggacaaaaaaaggtttcacattgttaacctcaccaattgctaacgaagctacggaaataaaaaatgatttacaaccctatcaagctgttatggtttctaaaattgtgacaacttccctaggtgattttgcctatgttacagataaaggttggattgcagtaaataatctttctaaaacggataatagagtagaagccgttcaagagttgttgactaacaaatattccaaagatactattggtatatatgtgaaacaattgtcaacaggtcaaactgcaggtgtaaatcaagagaaactattctattctgccagcattgctaaactaccaattctttattacgttcaagagcaactgaatgctggatatattgatttgactactaaagtgaaatatacagccgaatctatatccttcccaggagcttatgttgctggaggaagtggttcactgtcaaaaactcctgacaacaaagattattcagtggaagaattgatcaataagactgctaaagagtcagataatgtagctagtaatttactttcttattatgtagctaataaattcgattctaatttttatcaagtaataactgctaaaacaggtagtgagtggagtatggttacacgtgaaacttcagctgagattgcagggaaaatgatggaagccttatatattcaaaatggctatgtgctagaaagtttgttatctactcaatttgataatcaacgtatttcgaaagacatctcagttccagttgctcataaaattggcgatgcagacgatgtcaaacacgatgtagcgattgtttacgcagggtctccctttgttttatctatttttacagataaatcaaattatgatgagattacacaaattgcaaatgatatttacaggattttaaagtaaatgaaagatagatttttaaaagtgacactggatggtcacttttttgataaacataagaaagtactagtagccgtatctggtgggttagattctatgaacctattccatcttttatacgaatgcaaacaagtgttagggattgaacttggaattgctcatattaatcatggacagagagaagaatctgtcattgaggaaaaatatcttagacagttagcagaagaaagtaatgttcccttttatctgtcctattttgaaggtgttttttcagaagaagcggcgcgaaaatggcgttatggattttttgctacaatcatggagaaggaaggctacactgcactagtgacagcccaccatgcagatgatcaagcagaaactgtctttatgcgattgattagaggcgggcgtttacgtcacttatcagcaattcaaccgactcagccttttgcaacaggggaacttattcgaccacttttatcttttaaaaaggcagattttgaaaagctatttcattttgaagattgcagcaatgcagatttcaaatattttcgaaatagagtcagaaatgactatttaccaaagttaaaacaggaaaatcctaaaatcgaacttactctcaataatcttgcagttgatacaaataatctatttcaagcgctaagagatttgacacaggatttatccgttacagatgtgatgagttttcaacaacagacacctgcggtacaaagttatctattagaggaatatttggaaaaatttcctgatttacagctctctcgtccacaatttaatgaagtattacacatcttgcgttcaaaagctaactactatcatttattgaaaaatgattacatgctagaaaaggattatcatcgttttcaaatttataaaataggaccagagacggatagtcaaccagaaaaaatcatgatagaatcagaggggattttttcttacggttcatatattttttctctcaatcatcctttggaagaagcggatagtattttatattttcctacagaaaatccaattgtagtgaggagaaggcaggctggggataccattttaataaacggagtaaataaaaaactccgccgttggtttattgataataaaatctcacagaaagttcgacaaaatgcgcttattatcgagcagaatggagaaatttatggaattacgaatcttgttagcagtgatttgagtaaatcagtaaaaaatgatataatcaaagctaccttatatataaaaatgaaagagtagaacaactatgttggacaaagatattaagaaaattcttgtttcagaagaagaaatcgttgcaaaatgcaaagaactcggtcaaattctagcaacagactatgcagataagaatcctattcttgtaggaattttaaaaggttctatcccatttatggcagaattaatgaaacatattgatgcccatgtagaaacggattatatggttgtttctagctaccatggcggaacggagagttgtggtaccgttaagattatcaaggatttggacaatagtgttgcaggtcgatatatcatcttcgtagaggatattattgacactggtcgcacattaaaagaattgaaagaactctttgctttgcgtcaggcagcttctattaaaattgccactcttcttgataaaccagaaggtcgtgttgttgaaatcgagccagactacacttgctttactattccaaatgaatttgtagttggatttggcttagattatgatgaaaattatcgtaatcttccttatgttggtgtactcaaagaggaagtttacacaaaatagaaaaaggtttcctactatattatgaacaatcaaccaaataaaggatttataaaaaatccttttctcattattctcgttattgccactattgttacagcctttcaattttttaacgctggtcagcaagtagcaactcaagaaatcagttattcacaagtagtaactgaattgaaaaataataatgtatctgaaattacttatcaaccaaattcaagtgttattgaaattactggtaagtacaaaacagaacaggaagctaaagatgagttagcttcatctattaagttattccaagtttctagtaaagttaagtataaaaactttaagtcgctaattttaccgtcagaaacgaatttgtcagagctacaagctcttgcaaatgaaaatggagtaaaggttgctattaaacctgaaagttctaatggactatggttgaacattatctttaatttgttgccacttgttattgctggtgtattcttcatgatgatgatgaaccagggtggtggtggagcacgtggtgcaatgaactttggacggaataaagctaaagctttggaacaaagtaacatcaaggtacgtttctcagatgtagcaggtgcagaggaagaaaaacaagaattagttgaagttgttgaatttttgaaggatccaaaacgctttactaaacttggagcacgtattccagcaggtgtgctactagagggtcctccaggaaccggtaaaaccttgcttgccaaagcagtagcgggtgaagcgggtgtaccattcttctccatttctggttcagattttgttgaaatgtttgttggtgtcggtgccagccgtgttcgttcattatttgaagatgcaaaaaaagcagcaccagccattattttcatcgatgaaatcgatgctgtcggtcgccaacgtggtgtcggcatgggtggcggtaacgatgaacgtgaacaaaccctcaaccaactcttaattgaaatggatggttttgaagggaacgaagggattattgtcattgccgcaaccaaccgtagtgatgttttagaccctgcccttcttcgtccaggtcgttttgaccgtaaggtattggttggtcgtccggatgttaaaggacgtgaagcaatccttaaagttcatgcgaagaataaaccactagcagcagatgtagatttgaaattagtagcacaacaaacaccaggatttgttggtgcagatttagagaacgttctgaacgaagcagcccttgtagctgcacgtcgaaacaagactgtcattgatgcttcagatattgacgaagcagaagatcgtgttattgcaggtccatctaagaaagaccgtcaagtttcagccaaagaacgcgaaatcgttgcctaccatgaagctggtcatacgattgtcggccttgtcttgtcaaatgcacgtgaagttcacaaagtaacaattgttccccgcggtcgcgcaggtggatacatgattgcccttcctaaagaagatcaaatgcttctttctaaagaagatatgaaggagcaattggctgggcttatgggtggtcgtgttgcggaagaaattatttttaatacacagaccacaggagcatcaaacgacttcgagcaagctacacagatggcgcgtgctatggttgctgaatatggtatgagtgacaaaatgggaccaatgcagtatgaaggcagtcatgcaatgtttggtggacaaacaactcaaaaacatatttctgagcaaactgcatatgagttagataatgaagtacgtgatttgttaaatgaagctcgcaacaaagcggctgaaattattcagtctaatcgcgaaactcataaactaatcgcagaagcattacttaaatacgaaaccctagacagtgttcagatcaaatctctctatgaaacaggcaaaatgccagagaatattgaacgtgatgatgaagatgttcatcccctttcttatgaagaggtaaaagagaaaattaatacgaaagagtagtataaaaatactcttggcaagacattccctcactctcaaccactaaaataaccacaaagccttcgctaagtacataatcttggcgagggcttttttacatgatacacatcagaaacagggcatttacaagaaaaacgaatcaatagttatttatcacaatcttagaactataccaaatcactcccttcagaagcagaatgcaatatttgccatagagtatcaatagcaaatgtactttaaaaaagaaaaatcaaataaagtatgctagacaaaaatgtcctgtagaaagacagcacttttcgataaacttaaaccatcaacaaaaggagattaagtaatggaattcgaaaaagtgtacgcaagcgtcaaaggtattgtaaacaaggctcgaaaagagttttacattaaactatgggatcgagatgattgggaacaagaaggaatgatgaccttgtttgaattgttggaagctcaaccgtggctagttgatgaacaagttcaattatattgttattttaaagtcaagttcagaaatcgaatcaaagatcgtatccgcaaacaggaaagtcaaaaacgcaagtttgaccgtatgccacatgaagatatttacgaattatctcacgcaatacaatcaccgggattgataaacgatgaattattaatgttgagaggtgccttgagagattatcgaaaaaatctgagcaatgatcaacttgataaatacgaaaaattaattagcggacaatgttttaatggtcgccgtgaaatgatacgtgatttacaaattcatttgaaagactttcgctaaagctagttactaacatcacgttaatcgaattaagaaattgggcagaagcaccataaaaagttctgttcagtttctttttagataggttatagcacaggaagaaggaataggagaaaaaacaaagtatctacatagaactttcagtgtaaaaaatcccaaaaaaccggttgacaattgccaaagtagatgatagaataaatgagttgtctcttgagggactagttaacagaggaacgaaaaaagtttcgaaagagtgttgacaagaccatcagaagatgatagactaatagagttgtctcttgagggactggttaacagaggaacgaaaaaaagtttcaaaaaagtgttgacaaagttcacaagaaatgataaactaagatagttgtcgcgagagcgcgataacgacaagacctttgaaaattaaagaagacgaaccaaacgtgcagggtgatttatctaaagataaatcgtcaatgacaaaacaaaacaataaaacggaaagctagcaatagcttgagtttgaatcaaaactttttatgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaaatggaaacctgtacgtcagtcttctttaattttgagaggtcttgtggggccttagctcagctgggagagcgcctgctttgcacgcaggaggtcagcggttcgatcccgctaggctccattaacaacggaagttgttaagattttgtccattgaaaattgaatatctatcaaacattcctaaacgtatgtaaaagtacgtatagaaatagtaacaagaaaataaaccgaaaacgctgtgaatatttaatgagttttctaatttttgaaaaaattaggttaaaacaagttacgaagacgttaaggaaaacgtatgattttaggaaatcatcgcagtagtctaaggactacaagaggatttgtctaaatcactagttttctagtctgagtacgattataaggttaagttaataagggcgcacggtggatgccttggcactagaagccgatgaaggacgtgactaacgacgaaatgccttggggagctgtaagtaagcaatgatccagggatgtccgaatgggggaacccggcaggtaatgcctgtcactcactactgttaaggtagtgaagaggaagacgcagtgaactgaaacatctaagtagctgcaggaagagaaagcaaaagcgattgccttagtagcggcgagcgaaacggcaggagggcaaaccgaggagtttactcctcggggttgtaggactgcaatgtggacttaaagagtatagaagaactacctgggaaggtaggccaaagagagtaatagcctcgtatttaaaatattttttatacctagcagtatcctgagtacggcgagacacgcgaaatctcgtcggaatccgggaggaccatctcccaaccctaaatactctctagtgaccgatagtgaaccagtaccgtgagggaaaggtgaaaagtaccccggaaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcggattagtattatgtcgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacatttgagaatcttggaggtagagcactgtttggatgagggggccatctcggtttactgatttcagataaactccgaatgccaatgatttatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggataacactttagtgttatggtaggagagcgttctatgtgtgaagaaggtataccgtgaggagtgctggaacgcatagaagtgagaatgccggtatgagtagcgaaagatgggtgagaatcccatccaccgtaagactaaggtttccaggggaaggctcgtccgccctgggttagtcgggacctaaggagagaccgaagggtgtatccgatggacaacaggttgatattcctgtactagagtatgaagtgatggagggacgcagtaggctaactaaagcgggcgattggaagtgcccgtctaagcagtgaggtgtgatatgagtcaaatgcttgtatctgtaacattgagctgtgatggggagcgaagttaagtagcgaagttagtgacgtcacactgccgagaaaagcttctagcgatgtatcatactctacccgtaccgcaaaccgacacaggtagtcgaggcgagtagcctcaggtgagcgagagaactctcgttaaggaactcggcaaaatgaccccgtaacttcgggagaaggggtgctggcttaaagtcagccgcagtgaataggcccaagcaactgtttatcaaaaacacagctctctgctaaatcgtaagatgatgtatagggggtgacgcctgcccggtgctggaaggttaagaggagggtttagcgcaagcgaagatctgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctacgaagtcgggacgccagtttcgactgaggcgctgttgggatactacccttgtgttatggctactctaacccggataggttatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggacgggataaacgctgaaagcatctaagtgtgaaacccacctcaagatgagatttcccataactttatgttagtaagagccctgagagatgatcaggtagataggttggaagtggaagtgtggcgacacatgtagcggaccaatactaatcgctcgaggacttatccaaagaaataaactagagtcaatattgacaagcgatcggtttcttgttagaatatagatattcaattttgagttgacaagactcagtagttaagtgacgatagcctaggagatacacctgtacccatgccgaacacagcagttaagccctagaacgcctgaagtagttgggggttgccccctgttagatacggtagtcgcttagcaaattgggagtttagctcagctgggagagcatctgccttacaagcagagggtcagcggttcgatcccgttaactcccataggtcccgtagtgtagcggttatcacgtcgccctgtcacggcgaagatcgcgggttcgattcccgtcgggaccgttgaaacgaatcaatcatatgtttcaagtaatataattaagtaaagactcgttagctcagttggtagagcaattgacttttaatcaatgggtcgctggttcgagcccagcacgagtcatatgcgggtttggcggaattggcagacgcaccagatttaggatctggcgctttcgggcgtgggggttcaagtcccttaacccgcatagaatggaaataggccggcttagctcagttggtagagcatctgatttgtaatcagagggtcgcgtgttcaagtcatgtagccggcattaggaaagattgcgaacgtagttcagtggtagaacaccaccttgccaaggtgggggtcgcgggttcgaatcccgtcgttcgctttgagaggccggggtggcggaactggcagacgcacaggacttaaaatcctgcgatggcaacatcgtaccggttcgattccggtcctcggcatgaagattataatagttagcacccttagctcaactggatagagtacctgactacgaatcaggcggttagaggttcgaatcctctagggtgcatcactcgcttaatggagacgttaggggagctttatttttaatagtatcgggaagtagctcagcttggtagagtacttggtttgggaccaaggtgtcgcaggttcgaatcctgtcttcccgattatattattttggcggtgtagctcagctggctagagcgtccggttcatacccgggaggtcgggggttcgatccccttcgccgctatatactcttgtttgctggacctttagctcagctggttagagctctcggctcataaccgagcggtcgtaggttcaagtcctacaaggtccatatatcggaggattacccaagtccggctgaagggaacggtcttgaaaaccgtcaggcgtgtaaaagcgtgcgtgggttcgaatcccacatcctccttttctactaccgcgggatggagcagctaggtagctcgtcgggctcataacccgaaggtcgtaggttcaaatcctgctcccgcaatttctttaagaatttggctcggtagctcagttggtagagcaatggattgaagctccatgtgtcggcggttcgattccgtctcgcgccattaatttaactttgtccaagtttattatcttgggcgcgtagctcagatggttagagcgcacgcctgataagcgtgaggtcggtggttcgattccactcgtgcccatattatattgatggagaattactcaagaggctgaagaggacggtttgctaaatcgttaggtcgggtaactggcgcaagggttcgaatcccttattctccgtagtgaacgagattatcgcttgatattctcgttttattgtatcttggtgaggatatattatgaataaattttcaaaattagtagtagttgtttctatctttttattactgtcattttctcttttgtttgtgactttctctaaggggttacaggtaccatatttaaataatatcgttagggttgttgtaacgccaattcaatcggttatttcagtacctactagatttttttctgagcagaaagatgtcttgacagatttgatgaacgcttacgaggaaaataaacaattaaaggaaactattatgagccttgaagggatggctgctgaaaatactagcttgaaagaagagaatgcatcgcttcgtagcagtttaggtgtggtatctgattttcctgaaaaacaacttattccgggatcagttttagtgaggactccttcatcgtggtcggagcatatttcaattaatattggtgagactagtggtgtgacatataatgcacttgtggttgctaatggtggattagttggcatcgtgagttcattgagttcagattcggcggttgttaccttatttacgaattcggatgaattcacgaagttacctgtgaaaatttctgttgattctaaagaaatttatggtattttatcgggctatgatgcagatacaaatagttttatcattaatcagttgaactcagctgatgaaattgcagtgggtagcaatgttgtaacgagtgatttggctggtgagactccggcaaatgtccaaattggtaaagttttatcggttaaatcaaatagtaacagtttaaatagagaagtatatgttgagccgacagctagtttttcaaacatttattcggttttagtggtaggtcaaacaaatgcgcaataaaatgatagaaatattcatgtttcccatcttgttctttattttattacttgatggacagatttcaacgttggtaacaaattggtcggtcggattatttactatttcaagtcatttggtacttatgttagctattttttatgctaactatgtatctcttggtttttcattattcatatttactttgctaggtttggtatatgatattagttatcttaatctgattggtattgctactacaactcttcctttagttttatattgcatctatttcttctttcaaggtgctgtcagcaagcgaggaattaatattttgattttactagtagctatttttcaatttgaatttattagttattcatttgctcgtatttttcatataacaaacttgtctgtatttatctttgtttttaataaattacttccaagtttactattcaatttggtcttatttttcgtgttacaaccattatttgagcgtttatttggaataacaaacaagacatagaaatgtaataattgcgtaatatacttacgcgatttttttgataaaatgagagagtcagaaagtatagaggagttatgttcggatatgaagaaaaaaatcttggctacaattatgttaagtacagtcgttctatctaatgctaattatgtagctgtgattagtgcgaatgatgtagatagtcagattgcaacaaaaaatcaacagattagtgagttgacagcacaacaagcagaagctcaacaacaagttgatgctattcaaggacaagttgatgcaattgttagtgaacaggcgaaattaacagaagaaaatactcgtttggaagcagaatcgcagacattggcggcagatattgagcgtttgtcagctgatattgtgtcacgtgatggtgctttaaaggagcaggcgcgtagtgctcaagttgatggttctgcttcaagttacattaatacaattttggattcaaaatcaatcattgatgctgtttctcgtgttaatgcaatgcgtgagattatttcagctaataaccgtatgttagaacaacaaaaggctgataaggaagcaattgttgaaaaacaaaaggcaaatcaagaggcaatcactactttggcagctaatcgccaaaaattggaagatgacgcccaagtattgcaagtgcgtcaggctgaattggaagctgctaagttaaatttggctgtgcagaaagctactgctgaagatgagaaaaattcattgttggtgcaaaaggcagctgcagaagaagcagctcgtcaagcggcagctcgtcaagcggagtatcaagcacaacaggcagctctagcacagcaacaagtagcctcagtatcagcaccagtcgtgtcaacgctagtagaaactacagtgactgaaacggttgcagcccctactcagacagtatcacaatctacaccaacggtaagcacacctacaacgtctacatcatcaggttcaggtagttcagcggcagcaaataatgcgcgttatgacgcttcatcttacccagttggtgagtgtacttggggagttaaatctcaactttcatgggttggtccttactggggagatgctaaacagtggttagcatcagcacgtgctgaaggttttagtacaggttctactccacaagtaggtgcgattgctgtttggacaggtggttattatgggcacgtagcggttgttacggctgttcaatcttcaacaagcatccaagttgttgaatcaaactacatgggtcgtcgttatattggtaaccatcgtggtggttatttcaatccaacaacgacttctgagggagcggtttactacatttaccctccatattaagaaattttcaaatagagcgtgtggatttgcgctctatttttgtttgaaaaatgaaggaaaaagggttaaaatagtaaaggtagaaatatataggaggctgtcatggcgtttactgacttaaaattgttcgctctttcgtcaaatcagaagttagctgaacaggtgtcgaaaaaaataggaattcctctgggaaaatcaagtgttcgtcaattttcagatggtgagattcaggtaaatattgaggaatccattcgtggaactcatgtgtatattcttcaatccactagctcaccagttaatgataatttaatggaaattttgattatggtcgatgctcttaaacgtgcatctgctgaatcagtaaacgtagtaatgccttattatggttatgcacgccaagaccggaaggctcgtgcacgggaaccaattacatcaaaattggtggctaatatgttgcagacagcgggggtcaatcgtttgttgacaattgatttgcatgctgcgcagattcagggattcttcgatattcctgttgatcatttgatgggtgctccattgattgcggattattttgagcgtcgtggtatggtaggtgatggctatgttgttgtatcccctgaccatggtggtgtgacacgtgcccgtaagttagcacagttcttgaagacaccgattgctattattgataaacgccgtagtgttgataagatgaatacatcagaagtgatgaacattattggcgatattaaggataaaacttgtatcttgattgatgatatgattgatactgcgggtaccatctgtcatgcagcggatgctttggcagatgcaggggcaacagctgtttatgcttcatgtacgcacccagtattgtcagggcctgctatggataacattagtaagtcagcaattaagaaattggttgttcttgatacaattgaaattgcagaagatcgcttaatcgataaaatcgaacatatttcaacggcagaattattagcggaagcgattattcgtattcatgaaaaacgtcctttgtcacctttgtttgaggcaagtcgtgttaaataggtatgagaagagtcaaatgactcttcttttttacatttattttcaaaatgtattataatagttttatatgtttttgaggtggcagaatggatttattgaatcgttttaataagaatttgaatcggattgaggtttcgatgattcgtcagtttgatcagtctatttcggatgttcccgggattttgaaactgaccttgggagagcctgattttacaacgcctgatcatgtaaaagaagcagctaaggctgctattgatgctgatcagagttattatactggaatggctggtcttttggagttgcgtcaggctgcagctgagtttgtggctgaaaaatataatttacactacaatccagaaaatgaaatcctctctacaatcggtgcgacagaagctctgtcagcgagtttagttgctattttggaggctggggatacagttcttctgcctgcccctgcctatcctggttatgagccgattgtcaatatggtgggagcagacatcgttgaaatcgatacgacggcaaatgattttgtattgacacctgagatgttggaagaggcgattattgagcagggtgataagctaaaagctgtcattctcaactatcctgccaatccaacaggtgtgacctactcacgtgagcagattcaggcttttgcggatgtcttgcgtaactatcctgtctttgtcctatcagatgaggtctatgcggagttgacttacactggtcagcctcatacttcgattgcggagtttttgccagaacagaccattttgattcagggattgtccaagtcccatgctatgacaggttggcggattggcttgattatgagtcaggctcccatcatcgctcaaattatcaagagccatcagtatcttgtgactgcagcgtcaactgctatgcagtatggtgcggttgaggccttgaaaaatggtaaggatgacgctcttccgatgcgggcggagtacgtcaagcgtagggattacatcatcgagaagatgacggacttgggctttaaaattatcaagcctgatggagcattttacatctttgcaaaaattcctgcgggttacaatcaagattcctttagcttcttgcaagactttgcgagaaagaaagcggtggcctttattccaggcgcagccttcggtcagtatggagaaggctatgtgcgaatttcctacgcagcaagtatggagaagattcaaacagccatggctcgtttgaaggaatatctagaagaaaatggaacgaattgaaaccaggggattagtcctatataatcggaattttcgagaagatgacaagctggtcaagatttttacagagaaggctggtaagcgaatgtttttcgtgaaacatgcctctaaatccaagctggtagcttctatccagcctttgacctatgcggattttatcgttaaaatcaatgatgatgggctgtcttatatcgaagattttcatcaggtacagccctttaagaatattaacggtgatattttcaagcttagctatgctacctatatcttggccttggccgatgcggccttgcaggacaaggtctatgacccagctctctttgcttttttggtcaagaccttggacttgatggagtcaggtttggactacgaagttctgaccaatatctttgaaattcagctcttgggtcgatttgggatcagtctgaattttcacgagtgtgctttttgtcatcgggttggcttgccttttgactattcctacaagtacagcggtgtcttgtgtccgcaacactatcaacaagatgagcgacgggcttatctggatccaaatgttccctatctacttgatcaatttcaggctatttcctttgatgagctggaaaccatttccatcaagcctgagatgaagcgaaaattacggttttttattgaccagctgtacgaggaatatgtggggattcacttgaaatccaagaaatttatagatgatttgtcttcttgggggcagattatgaaaccaagaacagaaaatgaggaaacagaatgaaacgtattgcagtagatgctatgggtggggaccacgcccctcaggcagtggtagaaggtgtcaatcaagccttggctgcctttccagacattgaaattcaactttatggtgatgaggctaaaatcaagcagtatttgacagcgacagagcgtgtcagtatcgtccatacgacggagaaaatcaattcagatgatgagcctgtcaaggctattcgtcggaagaaagaggcttctatggtcctagcgaccaaggctgtcaaggatggtcaggcagatgcggtcttgtcagctggaaatacaggtgctcttttggcggcaggcgtctttgtcgtcggtcgcatcaagaacatcgaccgtcctggtcttatgtccactcttcctactatggacggtaagggatttgatatgatggatttgggggcaaatgctgaaaatatagctcatcatctctatcagtatggtattcttggctcattttacgcggagcacgtgcgtggtgtcaaacaacctcgtgtgggacttttgaacaacggtacggaagataccaagggcacgccagttcaccaagaagcctataaactcttggcggaagacaagtcgattaactttattggaaatgtggaggcacgtgagttgctcaacagcgtggcggatgtggtcgtgacggatggtttcacgggaaacgctgtgctaaaaaccattgagggaactgcaaaatccatcgttggtcagttgactggctcaatcaagaatggcggtctgcgtgctaaattgggaggcttgctggtcaaaccaaccttgaaaaaggccttgggggctatggactataaaactgcaggtggtgctgtcttgcttggtctgaaagcacctgtcatcaaggcgcacggctctagcgatgcccagtcgattttctatacgattaagcagacgcgttcgattttggaggctggcattgttgaaaaatcagtggccaaattttcagtagtggaggagagtcatgactagagagcaggtctatcagcgggttgttgaattaattcaggatgaaaagggagaagattttcaagttcaacctgaatctactttggcagataatattgcagcagattcagtagaaatcatggaatttgttcttaatttggaggatgaatttcatgtagatgtcccagatgctgctattgagcattttgaggttctatctgatattgttgattttatttataaagaagtaaaaaaacgttcgtagtttacgggcgtttttctttgttttttcctaaacaaccgtaaatttgttgtgaatgcgaatattgtgtgttagaataaacgaaaagactagaatatttcacgaaaggcgaacattctcatgaaaacagaccttctctattcaggaaaagccaaagacatctacgctacggctgacagcgaccagattgttgcggtttataaggatcaggcgacggcttttaatggtggtaagaaagaacagattgtgggcaagggccggctcaataatctgatttcatctttgatttttgaaaaattgaatgaagctggtgtcccaacgcattttatcaagcgtttgtcggattcggagcagttgaataagaaggtggagattattcctcttgaggttgttttgcgaaatgtgacagctgggtctttctcaaaacgctttggggtggaagaagggataaccttatctactcctatcgtggaattttactataaaaaagatgagttggacgatccttttatcaacgatgaacacattgcctttctagaactggctagtcaggaccaaatcgcctatatcaaggaagaaacaagacgaatcaatgagttcttgaaggacttgtttgctcagattgggctgactttggtggacttcaaactagaatttgggattgactcttctgggcaaattttattggcggatgagttttctcctgataattgtcgtttgtgggatgcggatggcaaccatctcgacaaggatgtttttcgtcgggggctcggggaattgaccgaggtttacgaggtcgtattggcaaaattacaggaagtgaaataaggattggaagatatggcaaagcggatttttgttgagaagaaggcagcatttcagatcaaggcggaggctcttcgtaaggagttgactcataatttgcagttgacaagcctgtcaagtttgcggttagtgcaggtttacgatgtcttcaatcttgaggaggacttgttagagcaggccatcaagcatatctttacagagcaggtgacggacaaggttttgtcggatgaagaattaggtctggaaggtgcagtttattttgctattgaggctttgcctgggcagtttgaccagcgggctgccagcagtcaggaggcccttctcttattgggcagtcgtcaggaggtgcgtgtcaatacaggtcagctctatattttgaacggtgatgtgcaggaagaagaattagttgccatcaagaattatttgcttaatcctgtggattcgcgattcaaggatatggatgctcctttggtggctcaggagttttcggtatcagatactgtcattccaagcttggacttttttgatagctacggggtagaggaatttgcgtcttacaagcgtgaggctggtttggctatggaagtggaagacctgctcttcattcaggattacttcaagtcaattggtcgagtgccaactgagacagaactcaaggtcttggatacttactggagtgaccactgccgccatacgacatttgagacagaacttaggtctattgacttttcagcctcaaaatttcaaaagcaattgcaggcgacatatgacaagtacttggcgatgcggacagaattaggtcggacagataagccacagacgctcatggatatggcgacgatttttggtcgttatgagcgggcaaatggtcgtctggatgacatggaagtgtcagatgaaatcaatgcctgctcggtggaaattgaagtggatgtggatggcgtgaaagagccatggctcctcatgttcaagaatgaaacccataatcaccctacagaaatcgagccttttggcggtgccgcaacctgtatcggtggtgccattcgcgatcctttgtcaggtcgttcttatgtttatcaagccatgcggatttcaggtgcaggcgatattacccaacctctgacagctactcgctcagggaaattgccacagcaaatcatttcaaaaacagcggcacatggttattcttcatacggaaaccaaatcggtttggcgacaacttatgtacgtgaatatttccacccaggatttgtcgcaaaacgtatggagttgggtgccgtagtcggtgcagctccaaaggaaaatgtggtccgtgaaaaaccagttgcaggtgatgtggtcatcttgctaggtggtaaaacaggtcgcgatggtatcggtggagcaacaggatcgtccaaggtgcagacagtcgagtctgtggaaacagctggtgcggaagtccaaaaaggaaatgctattgaagaacgtaaaatccaacgcttattccgcaatggtgccgtgactcgcttgattaaaaaatccaatgactttggtgcaggaggtgtctgcgtagctattggagaactggcagacggtcttgaaattgatttggataaggttccactaaagtatgcaggcttgaacggaacggaaattgccatttctgaatcacaagagcgaatgagcgtggttgtccgtccggaagacgtagatgcctttatcgcagcttgtcgtcaggaaaatatccatgcggttgtcgtagccaaagtgactgaaaaaccaaacctggttatgacttggaatggacaaaccattgtggatttggaacgttccttccttgataccaacggtgtgcgcgtggtggtggatgctaaggtcgttgacagtcctgtcaatctaccagaaacacgtacaacatctgcccaaacactacgagaggacttgaaagaccttctatcagacctcaaccatgctagtcagaaaggtttgcagacgattttcgactcatctgttggtcgttcaaccgtcaaccacccactcggaggtcgtcaccagctgactccgacagaaagttcggtgcaaaagttgcctgtccaacagggtgtgacgacaacggcttcggtcatggctcagggctaccatccttacctagcagactggtcaccttatcacggagcagcttatgcagtcatcgaagcgacagctcgcttggtggcaacaggggctaactggtccaaggctcgcttctcctatcaggagtatttccaacgaatggataagcaggcagagcgttttggtcagccagtagcggctctgctcggttcgattgaggctcagattcagcttggcctgccgtctatcggtggcaaggactccatgtctggtacctttgaggacttgacagttccgccaaccctggttgcctttggtgtgacaacagcagacagctgcaaggttctatcacctgagttcaaggcgactggcgagcacatttattacctaccaggccagattttatcagaagacattgatttcaccttgatcaagtctaattttaaggcttttgaaaaatggcagagcgattatgtgattacggctgctagtgcagtcaagtatggaggagttctagaaagtctagcccttatgtcctttggtaaccaagtcggagcaagagttgagcttgccgactttgaaaccagcttgacaggtcaacttggtggctttgtcttcacatcgcaagaagacattccagatgctgtgaaaatcggtcaaaccactacagactttacactggttgtcaatggtgtcaacctttctggacaggacttgcaagtagcttttgagggcaaactagaagaagtttacccaacagagtttgaacaggcgacggagttgcaggatgttccagcagtcacaagttcagcggttataaaagcaaaagaaaccgttgaagtgcctgtagtttacattccagttttcccaggcaccaactcagaatatgattctgccaaggcctttgaacaggctggtgcaaaagtcaatcttgttccatttgtgaccttggatgcagagagcattgaaaactcggttgacactatggttgacaatattgctaaggcgaatattctattctttgcaggtggattctcggctgcggatgaaccagatgggtctgctaagtttatcgtgactatcttacgaaacgccaaggtccgctctgctattgaccaatttatcgaaaaaagaggcctcatcatcggtatctgtaatggtttccaggcccttgtcaaatcgggcttgttgccgtatggaaactttgaggaggcgggtgataccagtccaaccctcttctacaacgatgccaaccaacacattgctaaaatggtggaaacgcggattgccaatgtcaactcaccgtggttggcaggtgtccaagtcggcgacattcacgctatcccagtttcccacggtgaaggaaaatttgtagtgacggacgaggaatttgctactttgcgtgataatgggcaaatcttcagccaatacgttgactttactggtcagccaagcatggattctaagtacaatccaaatggatccagccatgccattgagggtattaccagtcgcaacggacaaatcatcgggaaaatggggcattcggagcgttacgaggacggtcttttccaaaacattccaggcaagaaagaccaaggactctttgtttcagcggttcgctattttacaggaaaataaatatgacatacgaagttaaatcactcaatgaagaatgtggagttttcggcatttggggacatccgcaggctgctcaggtgacctattttggtctgcatagcttgcagcaccgtggacaagaaggagcagggattttagccaatgatggcggacaattgtgtcgccatcgcggaacaggcctgattgcagaagtcttcaaaaatccagcagatttagaagccttgacaggaacggctgctattggtcatgtccgctatgcaacttctggctctgcttctatcaataatatccagcccttcctatttgattttgcagatatgcaggtgggtttggcacataatgggaatttgaccaacgcggtcagtttgaaggctgaacttgaaaaaaatggttccattttctcttcttcttctgacactgagattctcatgcacttgattcgccgcagtcacaatccagactttatgggaaaaatcaaggaagccctcaatactgttaaaggtggctttgcttacctgatcttgttagaagataaattggttgctgccttggaccctaatggtttccgtccactttcaataggcaaaatgaaaaatggtgcctgggtagttgccagcgaaacttgtgcttttgaagtagtgggggctgactgggtgcgagatgtggagcctggtgaaattgtcgtcattgatgattcaggaattcaatatgatagctatacaagagatacgcaactggctgtttgctctatggagtatgtctattttgctcgcccagattcggtaattcacggggtcaatgtccacacggctcgtaaaaacatgggtcgtcgtttggcacaggagttcaaacatgaagcggatatcgtggttggtgtgccaaactcctccctatctgcggctatgggatttgcagaggaatctggtttgccaaatgaaatggggctgattaaaaaccaatatacccagcggacctttattcaaccaacccaggaattgcgggagcagggtgtgcgcatgaagttgtcagctgtttcaagtgttgtcaaaggcaagcgcgtggtcatgattgacgactctattgttcgcggtacaactagccgccgcattgtccagcttcttcgtgatgcaggtgcaaaagaagtccatgtggctattggcagcccagaactcaagtacccgtgtttctatggtattgatattcagacccgtcgggagctgatttcagccaaccataccgttgaggaagtctgtgagattattggggcagatagtctgacctacctttctcttgaagggatgatagaggccattggtatcgaaaccgatgcgccaaaaggcgggctctgtgtagcctactttgacggagaatttccaacgcctctctatgactatgaggaagaataccttcgtagcctagaagagaaaacgagtttctacattgaaaatgtcaagtaaagacagatgtgtcaacgttacttgacagacctgtaaactgttgaaaggaatcaaaatgacaaataaaaatgcctacgcccaatcgggcgttgacgtcgaagcgggatatgaagttgtcgaacgcatcaagaagcacgtagctcggacagaacgcttgggtgttatgggagccctcggtggttttggcgggatgtttgatctaaccaaactggatgtcaaagagccagtcttggtatctgggacagacggtgtgggcaccaagctcatgctggctatccagtacgacaaacacgacaccattggtcaagattgcgtggctatgtgtgtcaacgacattatcgcagcaggtgcagagccgctttacttccttgactacattgcgactggaaaaaatgagccagccaagctagagcaggtagtagcaggtgtggctgaaggctgtgtccaagctggttgcggattgattggcggtgaaacggctgaaatgcctggtatgtacggcgaggatgactatgacctggctggctttgccgtcggcattgcggagaaatcccagattatcgatggcagtaaggtccaggagggcgacattctcctcggcctagcttccagcggcatccactccaacggctattcccttgtccgacgcgtttttgcagatgtttctggggacgctctgttgccagagctcaatggcagagctcttaaggatgtcctattagagccgacacgtatctatgtccagcaggtgttgcctctggtaaaagcaggtctggtcaacggcattgcccatatcacaggcggtggcttcatcgaaaatgttcctcgtatgtttgctgacaaccttgcagctgaaattgaagaagataagattccagtcctcccaatctttacagcccttgaaacatacggccaaatcaaacacgaagaaatgtttgaaatcttcaatatgggtatcggaatggtcctggctgtcagtccagggaaggtggagaaagtccgtgaattggtaggcgaagaagtctatgaaatcggccgcattatcactaaggaagacaagagtgtggtcatcaaatgaaacgaatagcagtgtttgcatcaggcaacggctccaatttccaagtcatcgcagaacagtttgaagtagcttttgtcttttcagaccgcagaaatgcctatgtcttggaacgagctgaaaaactaggtgtaccaacctttgcttttgaactaaaagagtttgcggataagcaggcctacgaagaagccattatccaactattagaccagcaccagattgacttggtggtcttggcaggttatatgaagattgtgggaccaaccctgttggctcaatatgaaggtcgtatcatcaatatccacccggcttatttgcctgaatttccaggagcccatgggattgaagacgcttggaatgcaggtgtggcagaaagtggtgtgacagttcactgggttgacagcggtattgacacaggacaaattatcaaacaagtccgagtgcccaggctggctgatgatatcctagaaacctttgaagctagaatacatgaagcagagtaccaactctatccagcagttttggaggagttaggggcagtgaaaaaataaggagaaatcatgacaaaacgcgcactaattagcgtatcagataaaaatggtattgtagaatttgcccaagaattgaccaagcttggctgggaaatcatttcgacaggaggcacaaaggttgctcttgataatgctggtgtagcgactatcgctattgacgatgtgactggttttcctgagatgatggacggccgtgttaagaccctgcaccccaatatccacgggggtttgctggctcgtcgggatgtggatagccacttgcaagcagccaaggaccatgaaattggcctgattgacttggtagtggtcaacctttatcctttcaaagagaccatcttgcgtccggacgtgacctacgacttggcggtggagaacatcgacattggcggtccgtccatgttgcgttctgcggctaaaaaccatgccagcgtgaccgttgtggtagatccggcagattatccgacggttttaggggaaatagcagagcagggtcagacgacctacccaacgcgtcagcgattggctgccaaggttttccgtcataccgcagcctacgatgctcttattgcagactactttaccaagcaagtaggcgaagacaagcctgaaaaattaaccattacttatgacctcaatcagcctatgcgttacggtgaaaatccgcagcaaaatgcggatttctaccaaaatgccctgccaacagactattctattgcagcagctaaacagttaaatggtaaggaattgtccttcaacaacattcgtgatgcggatgcggctatccgtattatccgtgatttcaaggaccgtccaactgttgtggcactcaaacatatgaacccttgtggtatcgggcaggcagaaactatcgagaaggcttgggattatgcttatgaggctgacccagtatcgattttcggaggcattgtcgtgctgaacagagaagtggatgctgcgacggctgaaaagatgcacccaattttcttagaaatcatcatcgcaccgagctactcggcagaagcgttagctattttgaccaataaaaagaaaaatcttcggattttagaattggcttttgacgcacaggatgcaagcgaagtggaaaaagagttcacaggtgttgtaggtgggctcttggtgcaggatcaggacgtggtggtggaaagcccagcggactggcaggtggttaccgagcgtcaaccgtccgagcaagagtgggcggccatggagttcgcctggaagtcttccaagtatgtcaagtccaacggcatcatcatcaccaatgacaagatgaccttgggcgtgggaccggggcaaaccaaccgtgtagcgtccgtccgtatcgctatcgaacaagccaaggatcgtttagagggagccgttttggcgtcggatgccttcttcccatttgctgataacgtggaagaaattgctgccgcaggtatcaaggctatcatccagccaggtggctctgttcgcgaccaagactccattgacatggctaacaagtacggcttgaccatggtctttacaggagtcagacattttagacattgagagttttggatttagctcacttcgtgtgagcttttttattcccgaacattaccctgctttttctatcaaaacccgtctatttttgctatactatttatagaaaatccgtttttgaggtgtaaaaaatgaaacttttggttgtcgggtctggtggtcgtgaacatgctatcgcaaagaaattgttagagtctgagcaggtagagcaggtctttgttgctcctggaaatgacggaatgactttagatggtatcgagttagtcaatatcgggatctccgaacattctgctataatcaactttgctaaggaaaatgacgttgcttggacttttgtgggtccagacgatgctctggcagcaggaatcgttgatgattttgaacaggcgggacttaaagcttttggccctagtcgtctagccgcggagctagagtggtcaaaagactttgccaaacaaatcatggtcaaatacggcattccaacagcagcctttggcacattttccaacttcgaagaagccaaagcctacatcgaagagcagggtgcaccaatcgtggtcaaggcggacggcttggcactgggcaagggcgtggtcgtggcggaaaccgtcgagcaggcggtcgaagcggcacgggagatgctcttggacaacaagttcggcgactcgggtgcccgcgtggtcatcgaggagttcttggcgggtgaggagttttccctctttgctctggtcaatggcgaccaattttacattctgccgacagcccaggaccacaagcgtgcctttgacggcgaccaaggtcccaacacaggtggtatgggggcttacgctcctgttccccacctgcctcaaagcgtggtggacacagcggttgacaccattgtcaagccgattcttgagggcatgattgcggacggccggtcttatctgggcgtgctctatgctggcttgattctgaccgaccaaggtcccaaggtcatcgagttcaacgcccgttttggcgacccagaaacccagattatcctgcctcgcctgacctctgactttgctcagaacatcgacgacatcctccacaaacgcccgacacagctgacttggctggatagtggcgtgacgctgggtgttgtcgtggcatcaaacggctaccctctggactacgaaaaaggcgtagagttgccagcaaagaccgagggcgacatcacgacctactatgcaggggctcgttttgcggaaaatagcagagcactgctttcaaacggcggtcgggtttatatgctagtcaccacagcagacaccgtccaagacgcccaagaaaaaatttactcggagctgaaaaatcaagataccacaggcctcttttatcggacagatattggaagtaaggcagtaaaataagggataaagaaaaggaaagacaagcatgaacattccaatttccatcatcatgggttctagttccgactggaaaaccatgaaaaaagcagccgatatgctggacaaatttggcgtagcctatgaaaagaaagtggtctctgcccaccgcaccccagacctcatgttccgtcacgccgaagaagcgcgtggtcatggcttcaaggtcattatcgcaggagcgggcggtgcggctcatttgccaggtatggtagcagccaagacaaccctacctgtcatcggtgttcctgtccaatcccgtgccctcagcggtgtggattcgctctattctattgtgcagatgccgggcggcgtgcctgttgcgactatggcgatcggcgaagcaggtgccaccaacgcagccctgacagctcttcgcattctctccattgaagatcaaaccattgcggctcagctggcagattttgccaaggaacaggaaaaaattgcggaggcgatgacagatgacctcatctaagacaatcggaattatcggcggcggtcagctgggtcagatgatggctatttccgctatttacatgggccacaaggtgatcacgctggatcctgcggcggactgcccagcctccaaggtcagcgaggtcatcgtcgctccctatcacgatgtggcggccctcaaacagctggcggagcggtgcgatgtcctgacctatgagtttgaaaatgttgatgccgacggactggacgcggtcattaaggacggccagctccctcaagggactgacctcctccgtatttcccaaaaccgcatttttgagaaggattttttggcaaaaaaagctggcgtgcaagtcgccccctacaaagtcgtcacatctagcctagacctagaaggactggacctcagcaaaaactatgtcttaaagacagccactgggggctatgacggacatggccagaaggtcattcgagaagaggcggacttggtagaagctagtcagttagctaactctgccgagtgtgttttggaagagtttgtgaatttcgacctggaaatctccgtccttgtatctggcaatggctccgactacaccgtctttcctgtgcaggaaaatatccaccgcaataatatcctttacaaaaccatcgtgcctgcccgtatttttgacgaacttgctgaaaaagccaaaaccatggccctgcaaatcgccgacaagctccatttagtaggcaccctctgtgttgaaatgtttgtggcagggcaagaaattcttgtgaatgaaatcgctcctcgcccgcacaattcaggacattattcgattgaagcctgtgatttttcacagtttgacacccatatacgaggcattttaggggagcccctgccccctatccgcctgctttcaccagcagttatgattaacgttttgggacaagacatggaaacagtccaaacctttcttcaagaaaaccctaccgcccatccccacttttatggtaaactagaagcgaagcacaatcgcaaaatgggacacgtgacggtgttgggggaagatgcggaaagtgtggaggagtttgaaaattaagattgctttctgattttttagttattaaaaagaggtttatgacatgccattaccacaaaaaattcaagaagagattaaaagatattgcaataatcacttgcctaataatgactggtatgagaaagagtttgattttatacatgatgtgagtctgaagaatagaattattagagagtttaaatcaattcggtacgcttacaagttatacgaagggataacggctgaggaggaacatttaatttttgaaattcgcagtcaaattttagcatatgcctctatatatgaagcagtagtagagtacgttttagagacatactatagtgatactcaagtttatgatgatttggtccatcaaaataatgtgatgacaaaaattgacataccagaagaaaagaggaaaaaattagaaagagaattaatccatctagtagataatggtacaaaaaatatagaaatacatacatttttttatcaaagaaagaggaaggcatcaacttcaattcgttttgatgcaaagtgtcgtgcagcagaggaattaaatataatttcaaaaatttatcaaaaaggaaataaagttgttgcagatttaccatccgatattattgaaatttatgagtacaggaatgcaatccatttgatagccgagcaacgtaaaaacattgactatgaattagaacttagtcaacgagcgtatagaagaatgaaaccttttatagaacaaataaaagataggctaattacagataataaattaataataaaaaacaccaaggataccttgactgacagctctattaaaaattgaaagactaactcaatatgatagggagaagatattaattcagttgaataaataaaaattttagggagatatagggtgttaaataaagagtggtatttcaaaaattttaatatggtttcagagttggatatctcaggagaatttatatatactggtatttccattgtaaataatatggatagaattgctccagagatgcctacggaattatttttggctttatacaacatttctgtaggagtcgaaagactacagaaaataatattagtgttgtgggagttcgatgaggttgattccatagaagacttttctgaaagtctaaagattcataatcaagttgaattacatagcagaattgaaaaagcgatcaataaaaagatttttagtaaacaagaatgccaatttttagaacttttaaaagagttttattctaatgcgaggtatgatagattttcagcagtggggaatagatgggaatatgaacttattagtaaatttttctctaataattaaatcagttatgaagaatcagtttctgattctcaagtaattttaatcaacgatagtattaggaaattgatagggcgagtgctctctagaatagtaaaaaactactacctacttgtggaggaaggaagtaataaatcaggaacttattcatatgaactcagaaatgattcaaaagctcagaagatatttttacatatggagaatcgccgaggattaagttccataaaaatagatgaacggatagctttaagtgaaattcttatttatttgagaaatacatctgataaatcgtcatatttaaaatttattgagggaatatatcctcttgattttgataaaatggaaattagtagatatttatcaataattttactagaggatagaatccctcaagacttaattgatgaaattgaatatatttacgcagaaaaagatattaaggtaggagagcgaatagaaaacttagatttattaacaaaaaataatatgcaggttacattcgattatccttatttgaaggaagtatatataattttagaagaagtcaaaaaacaggaaagtattaacgatgatacaataagtaggttagaggagtctaactgttatattgacgatagtgatactcaagaaattatagaatctatcattgctgttgctcgccaatatcgcaataataaaattttgaaggaagagtttattaaagaatttagcagtcactacaaaactttagaagataattatacattaagttatattagtaacttgatgcaactagaagtaaggagcaaataaaatgattgaacgttattcccgcccagagatggcggctatttggagtgaagagaacaagtacgaggcttggttggaggtggaaatcctcgctgatgaggcttgggctgagttgggtgagattcccaaggaagatgtggccttgattcgtgagaaggcgacttttgacatcgaccgtattttagagattgaagaggaaactcgtcacgatgtggtggctttcacgcgtgcggtttcggaaagtcttggtgaggaacgtaagtgggtccactatggtctgacttcgaccgacgtggtggatacggcttacggctacctatacaagcaggccaacgacatcatccgtcgtgaccttgaaaactttaccactatcatcgccgacaaggctcgtgagcacaagtacacgattatgatgggccggacccacggtgtccatgcggagccaacgaccttcggtcttaaattagcaacttggtatagcgaaatgaaacgcaacatggagcgttttgatgtggcggccaagggcgttgaggctggtaaaatttcaggtgcggttggaaactttgccaatattcctccatttgtggaagaatatgtttgtggcaaattgggtattcgtccgcaggaaatttcgacccaggttcttcctcgtgaccttcacgcagaatatttctcagccctagccttgattgcaacgtctatcgagcgtatggcgacagagatccgtgggctacaaaaatctgaacaacgtgaagtcgaagagtatttcgccaaaggccaaaagggtagctctgctatgccccataaacgcaaccctatcggctctgaaaatatgaccggtctggctcgtgtggtgcgtggtcacttggtgacggcttttgagaatgtggctctctggcacgaacgcgatatttcccactcgtcagcggagcggattatcacgccggatacgaccattctcatcaactatatgctcaaccgttttggcaatatcgttaagaacttgacggtcttccctgaaaatatgaaacgcaatatggagtcaacctttggcttgatttacagtcagcgtgtcatgctcagcttgattgagaaaggcatgacacgtgaggaagcctatgatttggtgcaaccaaaaacggcgcaatcatgggacaatcaagtggacttcaagccccttctcgaagcggatgagcgtgtgactgccaaactcagtcaggaagaaatcgatgaactcttcaaccccgactactatgctaagcgggtggatgacatctttgaacgacttggattataaaaaaatcaaaattctttggattttccagagaatttttttgtttacttgcgaataaataggtgaaggggaaaacaagctccctccgctagacaatcattcgtaagaggatgagcagaaagtccagcctagcttctcagagttcgtatcaacatttcagcgcagtggttgattggcagattcgttcgcgtttcacgctccaaatctgacctaatcaactgtgcggggtgggaagacgaactctttagattggtcgagttctgtcccactcccaaaattttacgaatagataagtgtaggggaagcaagctcacaacttattcaaaaaaataagattttttcaaaaaaaagaaaacgatttgcgaataagtatagtgagagggaaaatccccctcaaggagatacacacttgaaaaaaataaatcattttcaaaatgatttacgaataaacaagtgtaggaaaaatgaaaggagaagaaggatgaaaaagaagttcaagattgtaaacaaacgtacaacgattgacctcgggattattaagtatagctaccgtcgtggtcgtcataccttgtaaatcaatcagtaaatcaaattgttaaagtaataggaggaaatagaaatgaacaaattttttaagaaaaataaacgtgtgacaatcgatctaggtattatcaaatacacctatcgtcgtggtcgtcatactttgtaaacagattagtaaatcatattatttgtaaatttttaaagaaaaaggagtaaaaatgaaacaattatttaagaagaataagcgcatcactattgatttaggtatcatcaaatacacttatcgccgcggtcgtcacactttgtaaaaagaacttgatagctaatttgatttagctatcaataagatgggaatttgttacagttcctatcttattgataaaaaggggaaacaatatgaatatgtttaggtcaatttttaagtcggtgatacatcgaagggatgttgctttgttctatgcttttgcgggtttgccaatcttagttcctatattgtccaaatttttggtaggcgtaaaggctgaatatacggataattttttagattttctaggagcagcattggcaacacaggacgggatagtgttacctgtattactgttatccttgattatttcagcagtctttagggacgagattgatagtggcattctatttttatataaagatctgaatagaacccgactttttaatgcaaaaatcattagtttagtggtgatgtatgcctcttatgtccttctaacagtgctgacaagtgcgattgcttattttggcttcttgaatgcttctggaaaagtagtatcggatgattggagtaatgtacagtccactttcctatctatttttgcaacaatttcaatcaatgttatcggtattttattggtttctacggtttctatcaaagccaaatccttacaggcagttttagcaggagttttttggtcactgtttacaacaactgcaccacttctcattggagttcgttatgttgtgccgaatggctatgctaagatgagtcttgatcagccactgcttgcatggtccttggtagtagctataacgacattttatactgttgctacctatctcaaaggtcgttcgaactttgaaaagctagaattttagaggtgttttatggtagtgcgctatatgaggccagttgctttatcgcttgctttgattgttttagcctccattagttatcttttggcaacatctttggttttgtttagctctagtcaatttctacagctagcctacctattttctattatggttggaatgccaatagggtttattctacttccatctatgataaccaagcgttatcagctttgtcaggagctatcggaagtgaagttcagttggaaaagctttgttttgctggctattgcaattttcttggtcaatttctggtttattcagagtgatgagtatgtgaatcaatttattattgcgacttgtgaagaattcttgttccgttatcttatctatcgtattctaaaaagtgaatatcctacttggctagctatgttggtcacttctctcttgtttggagttttgttgcatatgaattattccttgctggataatctaatcatccgaactccactaggtttattgttttctgtgttagctactcgttttggcttgcagtatgctatcggaggacattggatctacaatctgttggtttcgagatttccattttaattgtgagggtcatgatgatatttattctattattgagtctattttatatttgtttaacagttgctagttcgcaactattgctaagtctctctgttcctgttttattgttgttgacttatttgctaccgcccatcgtcaattcaatctgtatgggattacaaaaagataagtcttggaaagcgtggtcagcaggcattttcccaacaatgtcaatgatattttatgccgcttttgcctacattacgagtagcaatggtcagtgggagcagtttgctcaactgcatacagtttcagatgatgtcatgagtgtcgagctggcaggagaattgttagttccatcacaaatgctatttgttgccgtactatattatggtacagctattgccacttattttattcagcaggcaggtcgtaagaaagaaaaaggagctacttatgcttaaaatcaatcatttatcaaaacagtttgcaggaaatgaattttactcactaaaagatgtgagtttggagatcaataagggcgagattgttggtctgattggaaaaaacggtgctggaaaatccacgcttatgaaactcatggccaagtccctaaaaccaagttcgggaaccattacttataagggtacggatatttttagccaggataatttgttagcagactttgggattatgattgatccagtattctatccagaaatgactgttatggacaatctcaagttttatttggacctgcatgggaaaaaagacctctatccaaatattgagaagactttgaaattggtagagttatgggatgctcgcaatcggaaacccaagggattctcgttcggtatgaaacaacggacagctttggcgattgccttggttgcggagccagatttcctgatcttagatgagccttttgtgggcttggacccgattggtgttcaaaaattgattgatatcttgaagcagtggtccagtgagcgacaaatttccatgctgatttcgagtcaccaactaggtgagctggaggccttgtgcagccgctatgtctatatcgaatcgggagaattggcagatgcttttgaaggcaaatctcatccaagtgtgctcgtgcagttggacacgactaaaaacttagattctgtgaaggacttgctcaatgaccatgtggtgctagagggggaagtgttagagatttccactgccacacctacaagtgagctaaatcagatttttggtgtgttgactcgtcaagaattgattgtgaaactagaagtgaaagagaatcacttgaaagaaatctttacgaaagggtagtgagtatgaagcaaatttttccagctgtctttagaacgatttggaagcgaaaggagacgcaggtttatctcctattcactttgtttccttttatttatctagttacttcgtttattgaagggtcgaattttatgcagattcatgctggtgagggctataaagtcagccttgttgcctttacgaatatgatggtgagctcagcagatagtttcattcttcctagtttgaccctgtatttcttggctatatctgtctttaggaaagaagtagatgaacataccatgtttttataccgggatcttggacggaagcagattttctggtctaaatatttgggtctcttagcaacaatcgtcattttctatggtctcttctttgtaacctctgcatttgtacattatgttcgggtaatccatctaccttttggtagtccagctgtttttgaagctagtttggcagagagcttgagtaatgtattttgtattgtcgcttatttgctaaaagatattttatcgattagtttggcaactgctctttgtttgtatctgaaaaatattaccacaatgatcacaggatttttggtgacgattacgatgatgattttagcaattgttggcggtccagttgcgatgctttttccaactagttatatgactttggcgagcgaaggcctggcggggcttgcttatttaggagctatctgtgtcacaattatttacgtactcgtatttactaaaattgctgcgaaaaaattcaagaatttggagttctagttatgaataaaagactcgtcggagtgttgttgaagtcgctcaataaaacgatgttcttgtttgggatagttctgagtgcacttggggttggaatgggtttgttcctgccccagtttattggtaaattgctagatcaaacctatttgagcaatctattaacacggccagaattgctggcaggtttcatccttttctttgtatcggtctatgcagtacaggctctatctaattatttcatagggcgtagtggtagtaatgcactcaaacagttgcaacaatatatttatgaatccttgttgaccacatctgtaaaggacttggatcagtaccaatcaggtgatcttgctagtcgtttgactaatgatatgtcggttgttctgaacttcatcaccgttattcttccaaatttcttgatgaatggtttgatggttatggggtcaatttattttctgtggaccatcagtccgtggctcacgggtcttagtctcttcttgcttcctttgttgtcaatggttatgattccgatgaatcagcggttggaaggttactactctgcttaccaagagggattagggcaggtttctagtagaattagtcataaatttacaacgattcgtttgatgaaggcttttcagggagaaaagcatgaacagcgagagatgggcaagtcttttcagtatctgtcacaaacctttgagaaaatgattggactgtcagcggtgcaacataccttggttagtagcttaatgacgggatttattatcctgatgttgcttatagcggggatagaagtaaccaagggagtgatgaccatggctacattgacaacctttgtattgtacatgatgcaactgattgatccagtcacagacattgctgcttccctaaatgaactgacggagtttcatgcagtgtctaaacgtttggtagaattgctggaactgaataaggaagaacaggtagatacagagttggttgatgctactagtatccagttggaaaaagttcggttttcctatcatacagatccgattttgaatggagtatcggttagaattcctgagggagctcacgtggcgattgttgggccaagcggagccggaaagtcaacgatttttgccttgctgatgaaatattatcaagactataaggggaagattcggattggtcaacaatgtttaagtgatatttcaaccaaggagatgagaagattgatttccttcatacctcaggacaatactctctttcatgggacgattagagaaaatctattgtatggaaagaacgagtctgtgtctgaagagcgtattgcttatattctcaaggagttgggattgtctcctttagtagctgagttggaagatggtttagatactcggatttcagaaaatgggacaggcttgtcggaaggccaaaaacaacggttcagcattgcaagagccttactgctagaacatccgatttatttgctagatgaggcgacagcaagtttagatactgtcacagaacgtgtcattagcaaagcgattgaccgattaacagctggcaaaacaaggctaaccattgctcaccgtttgcatacggtgcgtgaggcagatgctattttggttttagataaaaatggacaagtagctgactacggtcatcaccagcagttagtggagagaaatcatctgtatcaagatttcttaagaggcttaccgcaagccagttagtgaatgggagtcaatggaccgaccagtctaagtctagggttacctaataataaaatggaatactgatgattacttgtacaatgaatagataggagaagagaatgaaacaaacaacatataccttatctttgggaggaagtgacagagagaactccagagtttcgaagatggaagaaaagtttgaaaaatatatggagggaatcgcagagcggttacagcaatctgggaagaagcgaattgacaaatggtttgttcatgtgcgaattgaggagtaaagtagctatgaccaaaattcacagacgtttttataaatagtgaaaaatagaatgaattctcttttagtttcccttaagtttggcgagttatactttattcaagctagaaatagcgagacttttactgaaatagtttcaatatcgtcatccgtaagagctaaagctcaaacggctggcatatcttttcaatccttatctctaagtcgcaagcgacaaggactagggattatataatctcctgagaatactggactcactgagtctggtattttcattttatgctataatggtttcatgacaaatcgaattttagatatggaacaaatgcaggacgaggaatatgtcgagcgtaccctgcgtccgcagaaattaaacgaatacatcggtcaggacaaggttaaggaccagctcaaaatctttatcgaggcagccaagctccgtgatgaagccttggaccatacccttctgtttggacctccaggtttggggaagaccaccatggcctttgtcatcgccaacgaactgggcgttaatatcaagcagactagtggtcctgttattgaaaaagcaggtgacttggtggcccttctcaacgacttggagcctggcgacgtcctctttatcgatgaaatccaccgtatgcccatggcggtcgaggagattctctactcagccatggaagacttctacatcgacatcatgattggggctggggaggccagtcgctccgtgcatttggagttgccgccttttaccctgattggagcgaccactcgtgcgggtatgctgtccaatcccctgcgggcccgatttgggattaccggtcacatggagtattacgaactggctgatttgacggagattgtcgagcggacggcggatatctttgacatggagattactcatgaagctgctattgagctggctcgtcggtctcgtggaactccccgtatcgccaaccgtctgctcaagcgggtgcgggatttcgcacagattatgggcgacggcctgattgacgatagcattacggataaggccctgactatgctggatgtggaccgagaggggctggactatgtggaccagaagattctccgcaccatgattgagatgtacggtggcggtcccgtcggcctcaacaccctgtcggtcaatattgccgaggagcgtgagacggtggaggacatgtacgaaccttacctgattcagcagggcttcctcatgcggacgcggacagggcgggttgcgacagccaaggcttacgagcacttgggttatccctatacggaaaaataatggcagagcagatgagacaagcagctcgtttatttggagactggcctgagacgattatctggacctgtttagaaggtgtcatgggagacatttatgttgatgacagccagttgccccagtcagccctagcactctacggacggcagagcttctttggttttttagctggccagccacatcgagacttgctaaaaatctgcgaaggtaaggatatgattctagtccctcaaaaccaaaactggtctgacttgatagaagggacttacggagacgggattcggtcctttacccgctatgctacgaaaaaggacactgagtttgaccttgggcatttacagaaactggttgatgacttgcctgaaagctttgatatgaaacggattgaccgtaatctgtacgaggcttgtctggtagaggaatggtcacgggatttggtgggaaattatatagatgtggaacaatttttggacttggggctgggctatgtcatcttgcacaaggggcaggtggtctcaggggcttcgtcctatgccagctattcagctgggattgagatagaagtggataccagggaagactatcgaggtctgggtttggcaaaagcctgtgcggctcagttaattttagcttgtttagaccgcggtctctatcctagctgggatgcccacaccttgacatccttgaaactggctgaaaagctgggctaccaattggacaagccctatcaagcatacgaatggagataagatgacaccgacatttatttgggatttggacggaacgctgttggattcctatgaagcgattttggcagggattcaagaaacctatcaagaatatgttcttccctttgaccgtgcagaagtaagaaagtttatccttcgctattctgtcaaggatttgctggtgcgtgatgcggacaagtacggtctggatagcgatgagctcaatcgtgtgcgtgcgacttccttgaaggaaaagaatacgcagattcccttgatggctggtgcggtggaaatcttaaactggactgcggaacaaggtattcaaaactttgtctatacccacaagagtgacaatgcttttcaggtcttggaggatttgggtgtccgtcaccatttcacagaaatcttgaccagcgattctggttttgcccgcaaaccaagtccagaagctctgctatttctcatcgaaaaatacggactggacaaggaaaatacctactatatcggtgaccgtttgctcgatgtagaaacagctgtcaacgcaggaattcacagtatcaacctgcaaattgatggtgtggagcagaattggaagattgtttctttattggacataaaacaaatattaacagataaatcaagtcataacaacctgtgaaaacgggtggcttgtacaccagctataagctgtttctctccagcgacgtctaaagatgtccgctgaacttcgttcaggttagtgctatgattacttgactaatgcccgtaacatcgggcttttgttttgttatggcttcaagctataataaaaatgagtccaaccgtctgttttaagaagagcatgatatggaatttgtgtaatatatttgatataatttaaaaagtatatttggaggtgtggtttatgaacgataaggaatttggacagcgtgtacgtcaattacgagaatctgctagtatgacacgtgaacagttttgtgacgatgaactggaactctctgtgcgccaattaactcgtattgaagcaggtgcttccaagccgactttttcaaagattcagtatattgcaactcgtttaggtatgggactttacgagcttatgccagattatgtatctttacccgaaagatattccaagctgaagtttgatgtgcttcgcaccccaacttatggtaatgaagatttggcggaaaagcgagatgccatgatgacagaaatctatgacgattattatgatgaattgcctgaggaggagaagatagcaatagatgcgattcaatcacgaattgatactttagagtcaggtacagcaggctttggaaaagagatactggaagactactttgaacaaatttttcgcaaacgaaagtatgaattgaatgatttgttgattgttaggctccatcttgaatatgttaggttatctagctgtgattcagaaatatttagacagtttttgaaaattatagagcatttacatgagcaaatcaatatcatcaactcaaatgatttatttgttttacgagacacgctattatcttgtgtaaatatattaggaagtaaaaaatattacgaaccaataccaaagatatttgacagtgtagataagattatacagtcgacacaagattttcagaaaaagcccattgttagtgtattaaaatggaaatatgcactttttgtggataaggatcgggatgaggcagaaaagcattatctagatgcggtgctatttgcaaaattgatagaaaatagagagttagaacagaagattgaagaagattggagagttgacaatcaataaagtgacatttttgtcctgttgaagaattgtgaaatgcattatactaaactcataaagattaaaggagattagtaacatgtttaactatttgaaattttttggtcgtcttggcggtaactggggaacatgggttgaagaataatattattaaaaagggagcgggaaagacatccatgatggctccgccctcacccacagaataatgaaaacgaacataaagccctcactaggtgtataatcttagtgagggctttgtggttaacgagttaatgatgttagtcatcgcgggaaaaactaactcactctactgacgagcaccccaaaatatgcgacaggcatgagtataaaaatacgactaaaattcggtagataagctctctaatttttagaaggagggaattatcatggatgttctctatcaatcttgtgcaggtattgatgtccatcaagccaatattgttgtctgtatcctacatggaccactcacctcaactcgtccaaagcgtgagatggctacatttgatacaacgactaaaggcctacgtgcttgccacgattttctcagtcaatttcatgtggaagctgttggtatggaaagcaccggtgtctattggcgacctgtctggcatgctctctgtgatgacttcgagctgatactcgctcaaccagcccacatgaaggctattccaggtcagaaaaccgacaagaaggacgctcactggattgccaaattaacacggattggtctgcttcctcggagtttcgttcccgatgaaaccattcaagaattgagggagttgaccagacaacgaaaacattatgtggaaagtcgcaatcgagaaacaaaccgtatccataaatttcttcagtcaggtggtatcaagctaacaacctatattgaagatattatggggctatctggtcgcaatctccttcagctactggttgatgggacgcctattacacctcgcattgttcatcaatccgtttataccagcttgaagaagaaagtgccgcagcttctggaagccttggacggttatttctctgaccatcatcgctttatgttaaagcagtccttagagatttatgatttttatcagaagcagattgagttgttggaagagcgaattactgtctatctatcacaatatgaaaaccatgtagaaacattggattccatcccaggcattgatgtcattacagcttctgttatcatttctgaggttggtgttgacatgagtcagtttccgacatctggacatttagcttcttgggctggactctgtccaggtaataatgagagtgctggtaaaaaacgaagtaccaagattcgacacggaaattcatatttgaagaaatgtttatgtcaagccgctttcgccgctaggaaccagaaaggaagtaccctagcagaccgattttatcagattcaaagtcggcgtggctcacaaaaagcaaccattgcacttgcgcatcaactattaaaaatagcctatatccttttaaaagaacagatgacttatcctgaatttttagcacaaaaaagactactagggacgagctagtagcctaatataaaaattgtttcactttgattctatcatagggagggagtttctgcattcttttgagttttcgtataagaactcgactggtcaaaaagagttcgtcaacaagtctttatttctagttgttgagctgaaacagtctattcccagacatcaatttatgtgagctgactgccgtcagcttatatctcccactttaaaaggtctcccagaccttttaaactcccacccccgtatagctccaacagtcagagtagtgactgttggaggttggagataaggcgaactctgttcgcatcagtcgtaatggtcagatttggagtgtaaaacacgaacaaatctaccaatcaaccactgcgctgagatgttgacacgaattctgagaagtgtgctggcttgagcccaatgtcattaagttaagcatttaaacaattaaagaaactattcccgtctgagcagttgatgacaagacgggaatagtttttgtatttagggcacacaaaaaggaaggtttttaacccaattttttaactattatgatattctataagtgaagcttacgggagcctggctttttatctttctttggaaggttcgattgggtcggatgatggataaatgtttggcaatgtaggtttctaattggaaggaagtaagttcttctctaagaaattttcgacaggcataaacagcgtctgaaaaacaaattttataagtctgttttaactttgatgttttaatggtaacgtgtgaggttagccatttacaaacattaaagttgataaagcgagcgtagatttcttgcagaatcccttccttctttttcgcatgaaaatgagtcaacccaatactgtattttaggtcacgaaaactggtctctatgccccatctgtaggcatagagatcttttaatttttctggtgaataatccgtatttgtcaccaaagtctcaaagaaacctggcttgatttcgagacgcaccatccgaaaatgaaggtcataaaactggagtggatccctttttcggctagagtttggtaaaaagtcaaaggatgtgtgattaggtaaacagcgatagtgattaggaaagtctcgatacagttgtttcatctcattggtttgttttcgacagatgtttaggtcaaatgcctcatcaaaacaaggggtgtcagggaggttaaatcctgacttcatagaatgattcccgacacgaatacgaataatataggaccaatttctttcttgacagtgtaccatgacattgtaggattcataccccctatccattatcaccagagcttgtttgaaagaagaggtcttcagcatgtcaataaaagctgctcgttcatcaagattcctagttagctgacttttccgactaaaatcttttttaggatgaagtaaaaactggtttgcggtggaaacgatgtcgttaatactatcaagtaaatgagctttaatctgatctagcatgacttttccccttttatttttagtgtactatagaaaaaactaacctaccacaaaacgtgataggttagttaacttaatgacattgggctttttgcccagcctcttttttgttatactagacagtatgtaggaggtggctatgttagaaaattggttaaacaccaaacaaggtcaggtgtttcattacaagatggaaaagattgagtatgccctagaactgctagggaatccccagtttgcagttccggtcattcatgtcgctggaactaatggcaagggatcgaccattgcctttatgcgcaagctatttcaggcacatggtatgcgtgttggaagttttgtatccccccacatggtgagtgtacacgacaggatttgtattgacagccagcccatttcagaccatgattttcagcactatttacagaaagtctacgatttggagcaggaaatcgccactcgttatgagccttttcgctattttgaggtcatggtgctcattatgttcctctatttcgaagctcaacaacccgatgtggcactagtagaggtgggcatcggaggacttttggatacgaccaatgtcgtggccccagccctaagcgttatcacctccatcggcatggaccatcaggatttattaggctcgactttaagggaaatagcagagcagaaagcagggattatcaaggaaagcgtacctgtcgtcctaggaccgctttctccagaaaccacagccatctgtcgccaaattgcccaagacaatcaagcacctgtctaccaatttggtcaggaattcacctataaagcaggacagttcagcaatccggacatcgacctgtcagaattggttttgggtctggctggccatcaccaagaagagaatgcggccgtagccctacaaacttttctactctatatgaccaatattcaaaaagacattcaacctcagttgattcaacaagcccttgcccaaaccagctggcctggtcgtttggaattggtagttcaagagccaaaaatctatttggatggagcccacaatgtccccgctatcgaacgtttgcttgaatttattcaggttcaagaagagcctgtcaccattctcttttcggcccttcggcgcaaggactttcaagaaatgcttgaattattagaagaaaaattgccacatactccacttgtattaaccagctttgcctatgatggtgccttggctgaggaaaaccgacaaggacgagattatgttgagaattatcagcaatttatagaagactggcaatctagcaagcaagggattttgattgttacaggctctctctactttatctcagaagttcgtcggatttttaaaaaatgaatatctttttgcgaataaataggtatgacacatgcagaaaaagtagcctttttaaaagaatttcaagagaacaaacgccatacttttcgccaattagaacagtttgcaaaaatttccagaactcccgataggaaatgacatcgggagtgctttttgatataataaggaaagcaaatccaaggagaagaaaatgacagaattagatgtagtttcggacgtagttactcatcctgaggaaacttatcggcgtagtcgtagagcatcacgtagacagcaagtgcaactgaatggtgaatttcatgaaagagtattaaagacaaagtattggccagctcttgtttggagcttagttttaagtgtttttagcgtagccaatccactgctaatgccatttgcaaccaatatacaaactcaaaatttatatgcagggatggcaatggcaaatggacaaatcccttatggtgatttctttggtacaagcgggttattattctacttacttgctttcttaggtcatctgggaggaactttcattatctttggaatcctccagtttatagcattactgatagcgggagtctatttctataagattgtagcttattttagtcagtcagaacacctagcgataagttctagtcattggttctatgtatttatttttgcacttggttttggagggatgtatgcagaaatgtttgctcttccgtttcttttgactagtgtgtggtttctggtccgctattttgaaaatgcagtgcgtgatgaggcatttatcctctacggaattgatgcggcattggtatttttaatttacccaaaaagtctgatcctttggttagttgcgggtctagttttatttatttttaatatccaacaccgccaagttactcgaggaatctatcaattattagcgaccatttttggttttcttctgattctatatgcggtaggttattatgcttttgaggcgcagattctggggacagctattcaacaaactttcctttataacttacagttagactttcaccattcctatctatatttagccttggcgattgtgtctgtatttttactcttatctggattctttaaaagtttcatccaaatggtgttttctttcaaacaaggaagacatacctatatcaaagttctcctattattgactttcttagttcaatgtgtctttattattgggaatgcaaactttcaatggagccaactcattcttcttttaccgtatggttttgcgatgtcagtcgtttacctgcgtgatgaggatgtagaagattatagtgggtatttgcgtcgtcaattctttcttccgttagctatttgcttgggtattatcgctcaacctgtttatctttatttggtacagggagatttgagaactgaccgtgaacaagttgccaattacattgatgaacaaacaaaagattcggataagatttatgtttgggataatagcgcaagcatctatctttcaagtcaacgtttatctgctgcaacgattactacagcagaaccctatctgaatactgacgacaataaaaatagcttgatgtatgacatcaataaaaatgaggcaaaatttgtagtcgtcaataagaatttgccaattctagatgaaatcaagacaaatttagaatcacagtaccagtctgttcagacaacggattactttacgatttatcaaaagaatgaatgattgctcaggcagtcattttttctttagcctatctgggaaaaggagggaaagtggatatgtggtataatggaaaaataagcattcgggaaaaattattaaagaaatgtaggagaaatgatgtcacatattattgaactaccagaaatactagccaaccagattgcggctggtgaggtcattgagcgaccagccagtgtggttaaggagttggtggaaaattccattgacgcaggggctagtcagattgaaattagtgttgaagaggctggcctcaaaatgattcaaattacggataacggtgaggggattgcccctgatgaagtagcgcttgccctccgccgtcacgccaccagtaagataaaaaatcaatcggatttgtttcgtattcgcaccctcggttttcgtggagaagccctgccctccattgcttctgtcagtcatatgatcattgagacagctacggcagactctgcacacggacttcatttggaggccaaaggtggtgtcatcgagaaagaggagccagttagtcgtccagttggtacgcagattactgtttcggatttattttacaatacccctgctcgtctcaaatatgttcgcagtcaacaggctgaattatcacatattgttgatgttgtaaatcgattgagtctagctcatccggaaatagcctttgtcttagtaaacgaaggacgagaattaattagaactgcagggacagggaaacttcgtcaggcaatttcagggatttatgggattgcttctgccaaaaaaatggttgaaattgaggcagaagatctggattttcagatttcaggttatgtttccttgccagagttgactcgtgccaaccgcaactacatttccatttttatcaacggtcgctatatcaagaattttttgcttaatcgagcgattttggaaggttacggcagtaagttgatggttggacgctttccgctggcagtcatttctatagaaattgacccctatcttgctgatgtcaatgtgcatccgaccaagcaggaagttcgcatctccaaggaaaaagaactcatgaccttgattcgagaggcgattagtcaagcacttaaagagcaggacttgataccagatgctcttgagaatttagctcagtcaagtactcgaccaaaagtaaaagcagagcaaggcaccttaccactcagagagccaaaaatctattatgatacgattaagcaagacttcttcttaaaaccagacgtggtcgctgaggatgtcaaacctctcgaagaggataggcaagagattgttgagtcgcctgtcgaaaatagacctacatctgttcaatttgcagaacgtcagtcggtggaatcagaagatcaggagcatcctaatctaagtgcaaaagaattggcaaaactggcagataaattagaccgggaggaaacatcgacatttccagagttagaatattttggtcaaatgcatgggacgtatttatttgcacaaggcaagacaggactttatatcattgaccagcatgccgcacaagagagggtcaaatacgaatactaccgtgagaaaattggacaagttgacaattcagctcaacagttattggtgccgtatatttttgaatttccgcagaatgatgcccttgacctcgtccacaaaatggatgcccttcgtcaagttggtgtcaacttggaagaatatggatctaatcaatttattctgcgtgaacatcctatttggatgaaggaagaggagattgagtctggcatttatgagatgtgcgacatgttgctcttgacggatcaggtgtcaatcaagcagtatcgggcagaactggccatcatgatgtcttgtaaacggtcaatcaaggccaatcatgctttggatgattattcggcgcgtgatttattgagacaattgtcttactgccaaaatccctataattgcccgcacggccgcccagtcttagtgcattttagcaaatcggatatggaaaaaatgttccgtcgcattcaagaaaatcacacgagtttgcgtgaattagggaagtattaacatagttgaaaaagttgacactttagcaaaggaagtatatgtacgactatattaaaggaattttaacaaaaataactgcaaaatacattgtggtagaaacgcaaggagtaggctatatcttgcaggttgctaatccctacgcctattcaggacaagtccagcaagaagtgactgtctatactcatcaggtgattcgtgaagatgctcatttgctctacggatttgctacagaaaatgaaaaatccgtctttctgagtctgatttcagtatcaggtattggtccaacaacagctctggctattattgctgttgatgataatgatggacttgttcgtgctatcgagcagaaaaacattacctacctgaccaaatttccaaagattggcaagaaaacagcccagcagatgattttggacttggaaggcaagtttgtcatgagcgaagaagcgggtcctgttcaacaagtagcaccatccagtgaaaatatcgcccttgaagaagccatggaagccatggaagcccttggttaccgcccagccgaactcaagaaaatcaagaaattctttgaaggcaccaacgacaccgcagaaaactacatcaagtcagcccttaaaatgctgatgaagtaataagatacaaaggacgtaaaggacaaagagaaaatagacggccgaacagaaattttgctagaaatttagttgtgagacctccgcaatgacaactaggtaaaaggcgagttttgacaaagccttttgccagatgtcaactgcgttattcggtgatatttaggattcagtttgacaatttttcaaagtatcgtagccgtgttcaactaacgtaccagtatgatggttaaaaagttttgttttgttactcaaagtttgagtcaacatttcagcgcagtggttgattggcagatttgttcgtgttccacacatcaaatctggcctaatcaactgtgcgggggcaggaagacgaattctttttctgcctgtcgaattctttcccgctcccactacagcaatcgctatttgcgacttgcctaggtaccttactaactcgccacaaaaataatgtcgatttttgtggctcatgtcgtgtccagatacaaagggcgtaaaggacaaagagaaaatagacggccgaacagaaattttgcaagaaatttcgttgtgagacctccgcaatgacaactaggtaaaaggcgagttttgacgaagccttttgccagatgtcaactgcgttactcagtgatatgtaggattcagtttgacaattttgcaaagtatcgtagccgtgtttcagtctgtttatcctgattcgtactttagttattcacgaaaaggagtttctatgtcccgttgtgcttgggtcaatcccaacaatccactttatattgcttaccatgatgaagaatggggcaagccacttcacgatgagcagtctttgtttgagttgctttgcttggaatcctaccaagcaggactttcctgggaaattgttctcaataaacgccaggcttttcgctctgcttttttcaactatgatattcaaaaggttgcggccatgacagatagcgagttagatagccttctgaccaatccagacatcattcgtcataaggcaaagctgtacgctacccgcgccaatgctcaggcctttcttcgagtacaggaggaattcggtacgtttgatacgtatctttgggaatgggttaactttacatctatcgacaaccctgtcaagtccttccgagaattgccgaccaagaacgacttgtctgagcggatttcaaaagatttgaagaaacgaggtttcaaatttgtagggcctgtctgtatttactcctatttgcaggctgcaggtctgttgaatgaacacgaagaaacttgcgagattggaaagaaattacgaactaattagatgagcgagcaatcgcaccctagacagaggaggaatatgaaagcagaactaatcgccgttgggacggagattttgacaggtcaaatcattaataccaatgctcagttcctttcggagaaatgtgcagagctgggaattgatgtttattttcatacggcagttggtgacaatgaaggccgtttattatcaacccttgaagtagccagcaagcggagtaatatggtcgttctttgcggtggtttaggaccaactgaggacgacctgaccaagcagaccttggcgaccttcttaggtagaaatcttgtgtttgatgagttggctatggcaaaattagaccgtttctttgccagtcgcccaggtcgtgtccgtacaccaaataatgaacgtcaggcacagattgtggagggaagtcaggcgctacagaatccagctggtttagctgttggtggtatgattgagcaagatggtgtaacctatattgttttgcctggcccaccaagtgagctcaaggccatgttttctgagagtctcttacctttactgtcccaatctcagcagcaactttattcgcgtgtcctacgcttttttggaattggcgaaagccagttggtgactgttttggcggacgtgattgataagcagacagacccaactcttgctccttatgcaaaagttggagaggtgactttacgcttgtccaccaaagcgaccagccaagaagaagcaaatctacgtttaaatcagttggaagaagacatcttacaacatgacaaactggcagactatttctatgcctacggagaggacaatagtttggtcaaaacggtagcgactcgtttggcggagaaaagacaaaccatcgctatcgtcgaacaggggacaggtggtctcttgcaagctgaattgagcctggctttggctgatcagccgtattttagcggaggaaaagtcgtcggtcagctagggatagaatcgggctggctatcagaggaagctgactgcattcggcaggagctgcaagctgatttaggtttggctgtgtctgtgcttatcaaaccggaatcaacagaggacaacgtacttgcaaaagtatacctcactttggctacgccctcgggtatttcccaaaaagagatagatttaggtggttattcgtggcaataccttcgccagcttgcttgtctgcaggcctgggattttgtacgaaacactttgtgaaatagcagatatttgctataatagtttgactaagaaaagaggagaaaatcattggctaagaaaccaggaaaaaaattagaagatattacaaagaaatttggcgatgagcgtaaaaaagcgttggatgatgccctaaaatcaattgaaaaagattttggtaagggtgctgttatgcgtcttggtgagcgtgctgagcaaaaagttcaagtcatgagctcaggtagcttatcaatcgacattgcgcttggagcaggtggctatcctaagggccgtatcattgagatttacggtccagagagctcaggtaagacaactgttgctctacacgcagtagctcaagcccagaaagatggtggtattgctgcctttatcgatgcggagcatgccttggatccagcctatgcggcggctcttggtgtcaatattgatgagttactattgtcacagccagactcaggggaacaaggtcttgaaattgcaggcaagctgatcgactctggtgcggttgacttggttgttgttgactcggttgcagcccttgtaccacgtgcagaaattgacggtgatatcggtgatagccacgttggtttgcaggctcgtatgatgagccaggctatgcgcaaactcggtgcatccatcaacaaaactaagacagtagctattttcatcaaccaattacgtgaaaaagtcggtgtcatgtttggtaaccctgaaacaacgcctggtggacgtgcgcttaaattctatgcatctgtccgtatggatgttcgtggaaacacacaaatcaaaggaacaggtgacaagaaagatcaaaacgttggtaaggaaaccaaggtgaagattgtgaagaacaaggtggctccaccatttaaagaagctgttgttgaaatcatgtacggtgaaggaatttctcgcacaggtgaattgattgagattggtagcaacctcggcatcatccaaaaagcaggggcttggtattcatataatggagaaaaaattggccaaggttctgaaaatgctaagaaattcttagcagataatccagcaatctttgatgaaattgaccgcaagatacgtgttcattatggcttgattgaagcagatggagttgaagaagttgcgaccgaagaagctcctgttgttgcggaagaaatccaagatgttatcctagatcttgatggcggtattgaattagaagattaattcctaacaaaatagatttaatattgaaccattgatgcatatctgttataggtgtgtatgaagttgtttagtataagaacgaaaaagtctggagattccaggcttttttctaataaaaaccgaatttttaccccaaaatttaaagtttttttaaaaaataggtctgcagaccgagggaatttatgatataatagtctataatgtgcttaataaaatgtagcaaaggagtgactacatgattaaaatttatactgtatctagttgtacttcttgtaagaaagcgaaaaattggttaaatgctcaccaattatcttataatgagcataatcttgcgaaggaagccattactaaggaagaaatcctaaacatcttaacaaaaacagagaatggtattgcaagtatcgtatcgtcaaaaaaccgttatgcaaagagtctggacttcgatattgaagagttgagtgtgaacgaggtcattgatttaattacctctaacccacgtattttgaagagtccaatcttgattgatgagaaacgacttcaagtgggctataaagaagatgatatacgcgctttcttgccacgtgcagtgcgcaatgttgaaaatgctcaagctcgtatgagagcagctctataagatgtacaaaaggactcttttggggttctttttgcgcattttttgagaataattaaaatttgtgatataatgtaaaaaatagggaaagaaggtgtaagtatgggatttaccgaagaaaccgttcgttttcgcctagatgatacagataaacaagaaatcagcaagacattgactagtgtttatcgttcgctggaggaaaagggctataatccgattaaccaaatcattggctatgtattaagtggggaccctgcttatattcctcgctataatgatgcccgcaatcagattcgtaagcatgaacgagatgaaatcattgaagaattggtgcgctactatttgaaagggaatgggattgacctctaatgagaataatgggattagacgtcggttccaagacagttggtgtagccatttcagatccgttaggtttcacggcccaagggttggaaatcatcccaatcgatgaagaaaagggcgaattcggtctggagcgtttgaccgaacttgtagaacagtacaaggttgataaatttgttgtaggcttgccgaagaatatgaataatactagtggtccacgtgtggaagctagtcaagcttacggtgatttattgactgagcgttacaaacttccagttgattatcaggatgaacgtttaacaactgttgcagcagaacggatgctgattgagcaagcggatatcagccgaggaaaacgcaagaaagttatcgataaattagcagctcagctgattttacaaaattatttagatagaacattttaaaggagattctaatggcacatcatcatgaccatgaacacgaccacaaccacgacgaacgtgaattgattactttggtagacgaccaaggtaacgaaacactttttgaaatcttattgacgattgacggtcaagaagagtttggtaagaactatgttctcttgattcctgcaagtgcagaagaagatgagaacggagaagttgaaatccaagcctactcatacattgagaatgagaatggcacagaaggcgatttgcaacctatcccagaagacgcaacagcagaatgggatatgattgaagaagtcttcaacagctttatggaagaggaataaaaaggtccgggtggacctttttatcatgagcatgaaaacaagaaagcgaattaaggtccagtggacctttttatcatgagctgaaaatcaaagagcgaattaaggtccggtggagtgaagcagtctgggggagactgtttcagcccgagttaagaaatagcaaggggaggaatgaatcatgagccagaaaatcaaaagggaggccagatgaaagatagttttacagaaagaagtaagaagctgagtgaggaattagagaggtgtctactggctgataaaaatattttggtcatattagacataatggatagactgaatttatcagattgctggctctgtgcgggaactatccgtaatttcatttggaatcaatacagttttgatgaagaaacagatgttgatcttgtgttttttgatgaaaatatttcttatgaagagacaatggaaatagaaagcaatttatatcaaaactatccagcctatcaatgggaattaaaaaatcaagtgtatatgcatatccatagtccgaatactaaaccgtatcaatcatcaagggatgcgattgaaaaatttccagaaagatgcacagcgataggtatttgtcgaacagaaagaaataaattagaaatatttgctccttttggattggatgacatttatgcttaccaagtacggccaacaccacatttcttagcggatcctaatcgcatggaattgtatcgacaaagaattcttaagaaacagtggaaaaagaggtggctatcgctaacagtaaaagagatttaactcccaccaagtaagtaggccaaaaacagtattttttataaactaaaacaatcaactacgggagattatgttatggaatttgaaacggtttgtttgaaggttagaaacttaggtaggctatattgctacttcaaagttaaatttagaacccatatcgaggctataattcgtaaacaggaaagtcaaaaatgtaaatttgatcgtctcctccatgaagatattcatagtttgattcaatcaccgagcttgggtaatgatgagttgctgatgttatggggtctcctgagagattatcgaaaaaatttaatcaatgaccgacttgaaaatatgaaaaattgataagcggacagagttttactggcagtcaaaaaaataattcgagacttacaaggatatttgaaaaaaaaacgttgatagttaactcaaataaaaaataagtaatgaagaatcctgaaataaaagttttgggattttttgaatttttgagtaaaaactcttgcaatggcaagtggaatctggtagaatgttctagtgccgtaaaaattacggctgtagctttgatgcaagaggttgcgacacgctcggttgcattgccacgcaacacgtgttggttttcttgtggagctagcctattatgttaaatagacgaaaaggagaaaaagatggcaaacaaaaaaattcgcatccgcttgaaagcgtacgaacaccgtacacttgatacagcagctgcaaaaatcgttgaaactgcaacacgtacaggtgctcaagtagcaggtccagttccacttccaacagaacgtagcttctacacaatcatccgtgcgactcacaagtacaaagattctcgtgagcagttcgaaatgcgtacacacaaacgtttgatcgacatcatcaacccaactcaaaaaacagttgacgctttgatgaaattggatcttccaagtggtgtaaacgtagaaattaaattgtaatcaagtcgcgagcaaaactcagaatcttgatttgagcatgaaaaacgctcgttaaaaactttttaaatacaaaataagaaaaggaatatttttctcatgacaaaaggaatcttagggaaaaaagtgggaatgactcaaatcttcactgaatctggtgaatttatccctgttactgtcatcgaagcaactccaaacgttgttcttcaagtgaaaacagttgaaactgatggttatgcagcagttcaagttggttttgatgacaaacgtgaagtattgagcaacaaacctgccaaaggccatgtagctaaagctaacacagctcctaagcgcttcattcgtgaattcaaaaacattgaaggcttggaagttggacaagaaattacagttgaaactttcgcagctggtgatgttgttgatgtaactggtacatctaaaggtaaaggtttccaaggtgttatcaaacgccatggtcaatcacgtggtcctatggctcacggttctcgttaccaccgtcgtccaggttctatgggtcctgttgcacctaaccgtgtattcaaaggtaaaaaccttgcaggtcgtatgggcggcaaccgtgtaacaattcaaaaccttgaagttgtacaagttgttccagaaaagaacgttatccttatcaaaggtaacgtaccaggtgctaagaaatctcttatcactatcaagtcagcagtcaaagctggtaaataataaggaaaggggaaatcagtcgaaatggcaaacgtaacattatttgaccaaactggtaaacaagctggtgaagtagttcttaacgatgcgatctttggtatcgagccaaaccaagcagttgtatttgatgtgatcatcagccaacgtgctagccttcgtcaaggtactcacgcagttaaaaaccgttcagcagtctcaggtggcggacgcaaaccatggcgtcaaaaaggaactggacgtgctcgtcaaggttctatccgttcaccacaatggcgtggcggtggcgtagtcttcggaccaactccacgttcatacgcgtacaaacttccacaaaaagttcgtcgcttggcacttaaatctgtttactcagaaaaagttgctgaaaacaaatttgtagctgttaactcacttgaattcacagctccaaaaactgctgaatttgcaaaagtacttgcagcattgagcattgattctaaagtccttgttattcttgaagaaggcaacgaattcgcagctctctctgctcgtaacatcccaggagttaaagttgcaactgcaacaactgcaagcgtacttgacatcgcaaatgcagacaaacttcttgtaactcaagcagctatctctaaaattgaggaggttcttgcataatgaatttgtatgatgttatcaaaaaacctgtcatcacagaaagctcaatgggccaactcgaagcaggcaagtatgtatttgaagttgacactcgtgcacacaaactcttgatcaagcaagctgttgaagctgcattcgagggtgttaaagttgcaaatgttaacacaatcaacgtgaaacctaaaacaaaacgcgtaggtcgttatgtaggtcgcacaaacaaagtgaaaaaagcaatcatcacattggctgctgattcaaaagcgatcgaattgttcgctacagctgacgctgaataatcaaaggaggaattaacgtgggtattaaagtttataaaccaacgacaaatggccgtcgtaacatgacttctttggacttcgctgaaatcacaacaagcactccagaaaaaagcttgcttgttgctttgaagagcaaagctggtcgtaacaacaacggtcgcatcactgttcgtcaccaaggtggcggtcacaaacgtttctaccgtttggtagacttcaaacgtaacaaagatggcgttgaagcaatcgttaaaactatcgaatacgatccaaaccgttcagcaaacatcgctcttgtacactacacagacggtgttaaagcttacatcattgctcctaaaggtcttgaagttggtcaacgcatcgtttcaggtccagaagcagatatcaaagttggtaacgcacttccacttgcaaacatcccagtcggtactgttgttcacaacatcgagttgaaaccaggtcgcggtggtgagttggttcgtgctgctggtgcatctgcacaggttcttggtcaagaaggtaaatacgttcttgttcgccttcaatcaggtgaagttcgtatgatccttggtacttgccgtgctactgttggcactgtaggtaacgaacaacatggccttgttaaccttggtaaagcaggtcgtagccgttggaaaggtatccgtccaacagttcgcggttctgtaatgaaccctaacgatcacccacacggtggtggtgaaggtaaagcaccagttggtcgtaaagcaccatctacaccatggggtaaaccagctcttggtttgaaaactcgtaacaagaaagctaaatctgacaaacttatcgttcgtcgtcgcaaccaaaaataatctattcttagttacatagcattctatatcatccgccaactcggtagggtttgttatggactgactattccagcacctcagtttgattgaaatgccagtttgacgcagtggttgattgcagtttctagtagcttagctacgtcgaaacttctaatcaactgtgcgggggcaggacaacgaacacggtaactggggttctgtccatctcccaagccgctgtggtacatattttaaaggagaaaacactaaaatgggacgtagtcttaaaaaaggacctttcgtcgatgagcatttgatgaaaaaagttgaagctcaagcaaatgacgaaaagaaaaaagtaattaaaacttggtcacgtcgttcaacgatcttcccaagtttcatcggttatacaatcgcagtttacgatggacgtaaacacgtacctgtatacattcaagaagacatggtaggtcacaaacttggtgaatttgcaccaactcgtacttacaaaggtcatgctgctgacgacaagaaaactcgtcgtaaataatttaggaggaaaacacaatggcagaaattacttcagctaaagcaactgctcgcacagtacgtgtttcacctcgtaaatcacgtcttgtcttggataacatccgtggcaaaagcgtagcagacgcaatcgcaatcttgaaattcacaccaaacaaagctgcaggcattatcgagggagttttgaactcagcaatcgctaacgctgaaaacaactttggtttggaaaaagctaacttggtagtcagcgaagcattcgcaaacgaaggaccaacgttgaaacgtttccgtccacgtgcgaaaggttctgcttcaccaattaacaaacgcacagctcatatcactgtagttgtggcagagaaataaggaggtaaaaacgtgggtcaaaaagtacatccaattggtatgcgtgttggcatcatccgtgattgggatgctaaatggtatgctgaaaaagaatacgcggattaccttcatgaagatcttgcaatccgcaactttatcaaaaaagaattggctgatgcgtcaacatcaacaatcgaaatcgaacgtgctgtaaataaagtaatcgtttctatccacactgctaaaccaggtatggttatcggtaaagctggtagcaacgttgatgcgcttcgtgctcaattgaacaaattgactggtaagcaagtacacatcaacatcatcgaaatcaaacaacctgatttggatgcacaccttgttggtgagtcaatcgctcgtcaattggagcaacgtgtggcattccgccgtgctcaaaaacaagctatccaacgtgcaatgcgcgctggtgcaaaaggtatcaaaacacaagtttctggtcgtttgaacggtgcggatattgcccgtgcagaaggctactcagaaggaactgttcctcttcatacacttcgtgcggatatcgactacgcttgggaagaagctttgacaacttacggtaaacttggtgttaaagtatggatctaccgtggtgaagttcttccagctcgtaaaaacactaaaggaggtaaataacaaatgttagtacctaaacgtgtaaaacaccgtcgtgaattccgtggaaaaatgcgcggtgaagctaaaggtggaaaacaagtagactttggtcaatacggtcttcaagcaactactagctcatggattacaaaccgccaaatcgaagctgcccgtatcgctatgacgcgttacatgaaacgtggtggtaaagtttggattaagatcttcccacacaaatcatacactgctaaagctatcggtgtacgtatgggttctggtaaaggtgctcctgaaggttgggtagctccagttaaacgcggtaaggttatgtttgaagtagctggcgtttctgaagaaatcgctcgcgaagcattccgccttgctggtcacaaattgccagttaaagttaaattcgtaaaacgtgaagcagaataaggagaagacatgaaacttcaagaaattaaagattttgtaaaagaacttcgtggcctttctcaagaagaacttgctaagaaagaaaacgaattgaagaaagaactcttcgaacttcgtttccaagctgctgctggtcaacttgagcaaactgctcgtttgaacgaagtgaagaaacaaattgcgcgtatcaaaactgtgcaatctgaaactaaataatagattgggaaaggagaatttcaatggaacgcaataatcgtaaagttcttgttggacgcgtagtatctgacaaaatggacaaaacaatcacagttgtagttgaaactaaacgtaaccacccagtctatggtaaacgtattaactactctaaaaagtacaaagctcatgatgaaaacaatgttgctaaagaaggcgatatcgttcgtatcatggaaactcgcccactttcagctacaaaacgtttccgtcttgtagaagttgtggaagaggcagttatcatttaatcaacctgaaaggagaaaattgacatgattcaaacagaaactcgtttgaaagttgctgacaacagtggcgcacgtgaaatcttgacaatcaaagttcttggtggttcaggacgtaaattcgcgaacatcggcgacatcatcgttgcttcagtaaaacaagctactcctggtggtgcggttaaaaaaggtgacgttgttaaagccgttatcgttcgtactaagacaggtgctcgtcgtgctgatggttcatacatcaaattcgatgagaatgctgcagttatcatccgtgaagacaaaaaccctcgcggaactcgtatctttggcccagtggcacgcgaattgcgtgatggcggtttcatgaaaatcgtttcattggcaccagaagtactttaatcaaatagttttaggaaatttgttacaaactaacgaagtctgtgacgggtttagtaaactagaaaacaaactaagtcccctggttaaatcactaaccagggtgcccattagggcgtaagaaattataggagaaatcaaatgtttgtaaaaaaaggcgataaagttcgcgtaatcgctggtaaagacaaaggcgttgaagcagttgtcgtaacagcacttccaaaagtaaacaaagttattgttgaaggtgttaacatcgttaagaaacaccaaaaatcaaacagcgaaaaccctcaaggcgctatcgttgaaaaagaagctccaatccatgtgtcaaacgttcaagttcttgacaaaaatggtgttgcaggacgcgttggttacaagtttgtagacggcaaaaaagttcgctacaacaaaaaatcaggcgaagtgcttgattaatcacgaaggaaaggagaagtataatggcaaatcgtttaaaagaaaaatatcttaatgaagtagttcctgctttgactgaacaatttaactattcttcagttatggctgtgccaaaagttgataagatcgttttgaacatgggtgttggtgacgctgtttctaacgctaaaaaccttgagaaagctgctcaagaattggctttgatctcaggtcaaaaaccacttatcactaaagctaagaaatcaatcgccggcttccgtcttcgtgagggtgttgcgatcggtgcgaaagtaactcttcgtggcgaacgtatgtatgaattcttggacaaattggttacagtttcacttccacgtgtacgtgacttccacggtgtaccaactaagtcatttgacggacgtggtaactacacacttggtgtgaaagagcaattgatcttcccagaaatcaacttcgacgatgttgataaaactcgcggtatggatatcgttatcgttacaactgctaacactgacgaagaatcacgtgcattgcttactggccttggtatgccgtttgcaaaataagagggagagaataaatggctaaaaaatcaatgatcgctaagaacaaacgcccagctaagttctctacacaagcttacacacgctgtgaaaaatgtggacgtccacactcagtttaccgcaaattcaaattgtgccgtgtatgcttccgcgacttggcttaccttggacaaattcctggcgtaacaaaagcttcttggtaagataagatgtgagagcgtttagcaaccaacgcaaagataggagattttacgacgaagtttacttctaggaaaatctatcttctttgctaagcttgtagctcgaactcaattaaaacatgatactaagggcgtgacggacaaagtgaaaataggaactctagcgaagaacgcttgcgttctagatagagttatctttttcacacaggccgtagcccgagttcaaatgttaggatgcaatagcatcatactagcaaattcaaactttgcattgcctatcaggcacacattaactagcaagtgatctaatcaaactgctagtaagaggagaaacaacaaatggttatgactgacccaattgcagattttttgacacgtattcgtaacgctaaccaagcaaaacacgaagtgcttgaagtacctgcatcaaacatcaaaaaaggtattgctacaatccttaaaaacgaaggttttgtaaaaaacgttgaattcatcgaagatgacaaacaaggcatcatccgtgtattcttgaaatacggaccaaacggtgaaaaagttatcacaaatttgaaacgcgtttcaaaaccaggtcttcgtgtttactcaaaacgtgaagatattcctaaagttcttaacggacttggtatcgcaatcatctcaacatcagaaggtcttttgactgacaaacaagctcgtcaaaagaacgttggtggtgaggttatcgcatacgtttggtaatcttttagcttccaatttcgtcatgtgcctgtgttagagcgtcttgacatactcaagtatggtctgcgtcgctctgccttgtcacatttagaaattgaaacctaaaagcatgatacaaatgcgagaggaccagttcttcgtgcgtgttcaaatctgacttactgattatttggtatcatgcaaccaaactagaacaagattcactaattgaacacgcctacaactctttgaaaaaagtgaaaagtgtttcagaaatccttaccttgttcgtcgtaaacgtctgaactttctctggccttcggtcaggaaagtcctagtcgttctgacgagggtgcgtctgcgaaatcaaagacttcggacttaccgcttatttttcttcgagttgcttaacggctttgtatcttgttcaccccgtgaaaactagtcgcttgacggcttgataatttaacaggagaattaaaaaatatgtcacgtattggtaataaagtaattacattgcctgctggtgttgagcttgctcaaaacaacggcgtggtaactgtaaaaggacctaaaggggaattgactcgtgaattcccaactgctattgaaatccgtgtggaaggtgcagaagtaactcttcaccgtccaaacgattcaaaagaaatgaagactattcacggtactagccgtgctaacctcaacaacatggttgttggtgtttctgaaggcttcaaaaaagaacttgaaatgcgtggtgtcggttaccgtgctcaattggctggtaacaaattgacacttgctgttggtaaatcacatccagatgaagtggttgcaccagaaggtatcacatttgaagttccaacaccaacacaaattgtcgtgtctggtatcaacaaagaagttgttggtcaaacagcagcttacatccgtagccttcgcgctcctgagccatacaaagggaaaggtatccgctacgttggtgaattcgttcgccgtaaagaaggtaaaacaggtaaataatagcttgctgaggtggctggaccacctggctgactatttctcaaattgtttcgtaagaaacagaatcatacattaagaggtgaatattgtgatttcaaaaccagataaaaacaaaatccgccaaaaacgccaccgtcgcgttcgcggtaaaatctctggaactgctgctcgcccacgtttgaacattttccgttctaatacaggcatctacgctcaagtgattgatgacgtagcgggtgtaacgctcgcaagcgcttctactcttgataaagaagtttcaaaaggtactaagacagaacaagctgttgttgtaggtaaactcgttgctgaacgcgcggtagctaaaggtatttctgaagtggtctttgaccgcggtggatatctctatcacggacgtgtgaaagctttggctgaatcagctcgtgaaaacggattgaaattctaatagggaggacactaagaaatggcattcaaagataacgcagttgaaattgaagaacgcgtagtagccatcaaccgtgttacaaaagttgttaaaggtggacgtcgtcttcgttttgcagctcttgtggttgttggtgaccgtaacggtcgcgtaggtttcggtactggtaaagctcaagaagtaccagaagctatccgtaaagcagttgaatctgctaagaaaaacatgattgaagtaccaatggttggtacaacaatccctcacgaagttcgctcagaatttggcggcgctcgtgtattgttgaaacctgcttcagaaggttctggggttgctgccggtggtgcaactcgtgccgtaatcgaattggcaggtatcgcagatgtgacttctaagtcacttggttcaaacacaccaatcaacatcgttcgcgcaacagttgaaggtttgaaacaattgaaacgtgctgaagaagtggctgcacttcgtggcatctcagtttctgatttagcataagaaaggagatactcatggctcaaattaaaatcactttgactaagtctccaatcggtcgcaaaccagaacaacgtaaaacagttgttgcacttggacttggtaaattgaactcttcagttgttaaggaagataacccagctatccttggtatggtgaacgctatctctcacttggtaactgtagaagaagttaaataatctaacaaatagactaagtcgcatagagaaatctttgcgacttctagtccattttacatatttacatacagcgagtttgtggaggaagactcttgtacttcacaggcgctagcatataaaagaggagaaataataatgaaacttcatgaattacaacctgctacaggttctcgtaaagtccgcaaccgtgtaggtcgtggtacatcatcaggtaacggtaaaacatctggccgtggtcaaaaaggtcaaaaagctcgtagcggtggcggtgtccgcccaggttttgaaggtggacaaactccattgttccgtcgtcttccaaaacgtggatttacaaatatcaacgctaaagagtacgcaatcgttaaccttgatcaattgaacgcttttgaagatggtgcagaagtaacaccagttgtgcttatcgaagctggaatcgttaaagctgaaaaatcaggaattaaaattcttggtaacggtgaattgacgaagaaattgacagttaaagctgctaaattctctaaatcagctgaagaagcaatcacttctaaaggtggctcagtagaagtcatctaagaggtggcagcctatgttttttaaacttttaaaagatgccttaaaggtaaaattggtacgtagtaaaattctatttactatctttatcctttttgtcttccgcgtaggaacccacattacagtaccaggagtaaacgcaaagagtcttgaggccttgtcaaaccttccgttcttgaacatgttgagtttggtttcaggaaatgctatgcgtaatttctcagttttcgcactaggtgttagtccttatattacagcttccatcattgttcaacttttacaaatggatattttacctaaatttgttgaatggggtaagcaaggtgaagttggtcgtcgtaaactaaatcaagcaacacgctacatttctttggtactggcatttgttcaatcgattggtattacagcaggctttaatgctttgtccggtgcaaaattgaccaatatgccattaaattggcaaacatatttgttgattggagcgattttgacaacaggttcgattattgtaacctggctgggggaacagatttctgaaaagggctatggtaatggtacatcaatgatcatctttgcaggaattatttcatcgttaccaggaacttttcacgagatttacattgatcgctttgttaatattgaatcaagtcgtttgggggaatcagcaatctttgttgctgcactcgtcgtattaatattctttgttgtgtattttacaacttttgtacaacaagcagaatataaattaccaattcaatatacaaaacgtgcacaaggagcaccttctagctcatatttacccctgaaattgaatccagcaggagttattcccgtaatctttgcaggctcaatcactgcagttccaacttctttgattcaatatttcgcaagtcaaaataagagtgccgggtggttattgacggttcaggaatactttgattattcaactgctaaaggtatgattgtatatgcaggtttaattattgcctttacattcttctacacctttgttcaagtaaatcctgagaagactgcagaaagccttcagaaaagtgcagcctatatccatggagttcgtcctggtaatggcactgaacagtttttgtcaaaattattgacaagattggcagtaatcggtgcactcttcttgagttttgtagctttgctgcctatccttgcgcaaaatctctttgggctttcttcaagcattgcgttccttggtacaagtttgattatcgtaatctctacaagtatcgaaggcatcaagcaattagaaggctaccttcttaagagaaaatatgtaggtttcttagaaattacagaatagaatataggttgacctagtcaaccttctattttgtttttagataagtttgtcaataatggcaaatttatgtgaaaacaaaataaggagtttgtcatgaatcttttaattatgggtttaccaggtgctggtaaagggacacaagcggccaagattgttgagaaattcaatgttgctcatatctcaacaggagatatgttccgtgcagcaatggccaatcagactgaaatgggtattcttgccaagtcgtacattgataagggtgacctcgttcccgatgaagttactaatggcattgtcaaagaacgtttggttcaggatgacatcaaggaaaaaggctttttgcttgatggctatcctcgtacgattgaacaagcccatgccttggatgaaaatttggctgacttaggaattgagttgcaaggtgttatcaatattgagattgatccttcaaaattggtagagcgtctcagcggtcgtattattcataaagaaactggagagactttccacaaagtattcaatccacctgttggagactacaaagaggaagacttctatcaacgtgaagatgacaagccagaatctgtcaaacgtcgtttagaggtcaatatcgcacaaggacagccaatcattgatcattatcgtgcaaaagggctggtccatgatattgaaggtgaccaagacattgaccttgttttccaagcaattgatacagtactatcaaaattgcaataaactaatagatttggcttgcattttttatacaaagatgataaaatagtctagtctgacttataattgttacctctgtgttcagaggacatcaaatcgatatttagagaggggttacttttgcatggcaaaagaagatgtgattgaaattgaaggcaaagtagtcgatacaatgccaaatgctatgtttactgttgagttggagaatggacaccaagtccttgcaactgtttcaggtaaaatccgtaaaaactacattcgtattttggtcggtgaccgcgtaactgttgagcttagtccatacgacttgacacgtggacgtatcacataccgctttaaatagtcgaaatacttggagggattaaacatgaaagtaagaccatcggtcaaaccaatttgcgaatactgcaaagttattcgtcgtaatggtcgtgttatggtgatttgcccagcaaaccctaaacacaagcaacgtcaaggttaagaaatagaaaggagaaaacatggctcgtattgctggagttgacattccaaatgacaaacgtgtagttatttcattaacttatgtttatggtatcggtcttgcaacatctaaaaaaattcttgcagctgcaggtatttcagaagatgtacgcgtgaaagatttgacatcagatcaagaagatgctattcgtcgtgaagttgatgcaatcaaagttgaaggtgacctccgtcgtgaagttaacttgaacatcaaacgtttgatggaaatcggttcataccgtggtatccgtcaccgtcgtggacttcctgtccgtggacaaaacactaaaaacaatgcccgcactcgtaaaggtaaagctgttgcgatcgcaggtaagaaaaaataaaataggaggtagaaaaattggctaaaccaacacgtaaacgtcgtgtgaaaaagaatatcgaatctggtattgcacatattcacgcaacatttaataacactattgttatgattactgatgtgcatggtaacgctattgcttggtcatcagctggtgctcttggtttcaaaggttctcgtaaatctacaccattcgcggctcaaatggcttcagaagctgctgctaaatctgcacaagaacacggtcttaaaacagttgaagttaccgttaaaggcccaggttcaggtcgtgagtctgctatccgcgctcttgctgccgctggtcttgaagtaacagcaattcgtgatgtgactcctgtaccacacaatggtgctcgtcctccaaaacgtcgccgtgtataatcatacattccatacacagcttttcgtttaagagggagtaagaaatgattgagtttgaaaaaccaacaataacaaaaattgatgaaaataaagattacggcagatttgtaatcgaaccattagaacgtggttacggtacaactcttggtaactctcttcgtcgtgtacttcttgcctcacttccaggtgctgcagtaacatcgattaaaattgatggtgtactccacgaattcgacacagttccaggtgttcgtgaagatgttatgcaaattattcttaacatcaaaggcattgctgtaaaatcttatgtcgaagacgaaaagaaaattgaacttgatgtagtaggtccagctgaagtaacagcaggagacattcttacagatagtgacattgaaattgtaaaccctgaccattatctctttaccattgctgatggtgccacttttaaagctgttttgactgtcaattcaggtcgtggttatgtaccagctgaggataataagaaagatgatgcaccagtgggaacacttgctgtagattctatctatacgccagtgaagaaagtcaattatcaagttgaaccagctcgtgttggtagcaacgatggttttgacaaattaacacttgaaatcaacacaaatggcaccattattccagaagatgctttaggtctttctgcacgtattttgatggagcacttaggtctcttcactgacttgactgaagttgcaaaatctgcagaagtgatgaaagaagctgaagtggcttcagatgatcgtatgcttgatcgtacgattgaagaattggatctatctgttcgctcatataactgtctgaaacgtgcaggcattaacactgtattcgacttgacagagaaaactgagccagaaatgatgaaagtgcgcaatcttggtcgcaagagtcttgaagaagttaaagttaaattggctgatcttggtctaggattgaaaaaagataaataatataggaggaaatcatggcataccgtaaactaggacgcactagctcacaacgtaaagcaatgttgcgcgatttgacaactgaccttttgatcaacgaatcaatcgttacaactgaagctcgtgctaaagaaatccgtaaaacagttgaaaaaatgatcacacttggtaaacgtggtgatttgcacgcacgtcgtcaagcagcagcatttgttcgtaacgaaattgcatctgaaaactatgatgaagcaactgataagtacacttctgctacagcacttcaaaaattgttctctgaaattgcacctcgttatgcagaacgtaatggtggatatactcgtatcctcaaaactgaaccacgtcgtggtgatgctgcaccaatggcaattatcgaacttgtataagatcatcaattttgttgagtgttatgatgatggaatcctattctgattcttagtctagctctggtctaccgctgagcttgtctcagcggtaacactcatcatgttgattggacgcttgtttacgaaattactctaagatagaataatttcgtaagcaggcgtttttattttactcaaaaattttgatatactggaggcatacgaagaaaatatacaatctccgattagtatgcctctcagtttttcgccaaatttcataaaaaaatccaaaaaaccggttgacaatgtatataagtcgtgatagaataaatgagttgtctcttgagggactagttaacagaggaacgaaaaaagtttcgaaaaagtgttgacaagaccatcagaagatgatagactaatagagttgtctcttgagggactggttaacagaggaacgaaaaaaagtttcaaaaaagtgttgacaaagttcacaagaaatgataaactaagatagttgtcgcgagagcgcgataacgacaagacctttgaaaattaaagaagacgaaccaaacgtgcagggtgatttatctaaagataaatcgtcaatgacaaaacaaaacaataaaacggaaagctagcaatagcttgagtttgaatcaaaactttttatgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaaatggaaacctgtacgtcagtcttctttaattttgagaggtcttgtggggccttagctcagctgggagagcgcctgctttgcacgcaggaggtcagcggttcgatcccgctaggctccattaacaacggaagttgttaagattttgtccattgaaaattgaatatctatcaaacattcctaaacgtatgtaaaagtacgtatagaaatagtaacaagaaaataaaccgaaaacgctgtgaatatttaatgagttttctaatttttgaaaaaattaggttaaaacaagttacgaagacgttaaggaaaacgtatgattttaggaaatcatcgcagtagtctaaggactacaagaggatttgtctaaatcactagttttctagtctgagtacgattataaggttaagttaataagggcgcacggtggatgccttggcactagaagccgatgaaggacgtgactaacgacgaaatgccttggggagctgtaagtaagcaatgatccagggatgtccgaatgggggaacccggcaggtaatgcctgtcactcactactgttaaggtagtgaagaggaagacgcagtgaactgaaacatctaagtagctgcaggaagagaaagcaaaagcgattgccttagtagcggcgagcgaaacggcaggagggcaaaccgaggagtttactcctcggggttgtaggactgcaatgtggacttaaagagtatagaagaactacctgggaaggtaggccaaagagagtaatagcctcgtatttaaaatattttttatacctagcagtatcctgagtacggcgagacacgcgaaatctcgtcggaatccgggaggaccatctcccaaccctaaatactctctagtgaccgatagtgaaccagtaccgtgagggaaaggtgaaaagtaccccggaaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcggattagtattatgtcgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacatttgagaatcttggaggtagagcactgtttggatgagggggccatctcggtttactgatttcagataaactccgaatgccaatgatttatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggataacactttagtgttatggtaggagagcgttctatgtgtgaagaaggtataccgtgaggagtgctggaacgcatagaagtgagaatgccggtatgagtagcgaaagatgggtgagaatcccatccaccgtaagactaaggtttccaggggaaggctcgtccgccctgggttagtcgggacctaaggagagaccgaagggtgtatccgatggacaacaggttgatattcctgtactagagtatgaagtgatggagggacgcagtaggctaactaaagcgggcgattggaagtgcccgtctaagcagtgaggtgtgatatgagtcaaatgcttgtatctgtaacattgagctgtgatggggagcgaagttaagtagcgaagttagtgacgtcacactgccgagaaaagcttctagcgatgtatcatactctacccgtaccgcaaaccgacacaggtagtcgaggcgagtagcctcaggtgagcgagagaactctcgttaaggaactcggcaaaatgaccccgtaacttcgggagaaggggtgctggcttaaagtcagccgcagtgaataggcccaagcaactgtttatcaaaaacacagctctctgctaaatcgtaagatgatgtatagggggtgacgcctgcccggtgctggaaggttaagaggagggtttagcgcaagcgaagatctgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctacgaagtcgggacgccagtttcgactgaggcgctgttgggatactacccttgtgttatggctactctaacccggataggttatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggacgggataaacgctgaaagcatctaagtgtgaaacccacctcaagatgagatttcccataactttatgttagtaagagccctgagagatgatcaggtagataggttggaagtggaagtgtggcgacacatgtagcggaccaatactaatcgctcgaggacttatccaaagaaataaactagagtcaatattgacaagcgatcggtttcttgttagaatatagatattcaattttgagttgacaagactcagtagttaagtgacgatagcctaggagatacacctgtacccatgccgaacacagcagttaagccctagaacgcctgaagtagttgggggttgccccctgttagatacggtagtcgcttagcaaattgggagtttagctcagctgggagagcatctgccttacaagcagagggtcagcggttcgatcccgttaactcccatataagcgggtgtagtttagtggtaaaactacagccttccaagctgttgtcgcgagttcgattctcgtcacccgctttgaacatagttcatacccaaacttggtttgggcgcgtagctcagatggttagagcgcacgcctgataagcgtgaggtcggtggttcgattccactcgtgcccattatatggtccgttggtcaaggggttaagacaccgccttttcacggcggtaacacgggttcgaatcccgtacggactatattattcggaggattacccaagtccggctgaagggaacggtcttgaaaaccgtcaggcgtgtaaaagcgtgcgtgggttcgaatcccacatcctccttactattatcgcgggatggagcagctaggtagctcgtcgggctcataacccgaaggtcgtaggttcaaatcctgctcccgcaatttctttaagaatttggctcggtagctcagttggtagagcaatggattgaagctccatgtgtcggcggttcgattccgtctcgcgccattaatttaatattatatttcggagagatagcgaagaggctaaacgcggcggactgtaaatccgctccttcgggttcgggggttcgaatccctctctctccatacctttacgggcatagtttaaaggtagaactaaggtctccaaaaccttcagtgtgggttcaattcctactgcccgtgttatatggcgggtgtggtgaagtggttaacacatcagattgtggctctgacattcgggggttcgattcccctcactcgcctattttaatattggggtatcgccaagcggtaaggcaagggactttgactccctcatgcgttggttcgaatccagctaccccagttcaactatatgccggcgtggcggaattggcagacgcgctggactcaaaatccagtgtccgcaaggacgtgccggttcgaccccggccgccggtatagtttaaaagacaaggtttctaagccttgtcttttgttttatcttttctattgctctttttcaagttgccaaaaaattccattttctaaaaaatatcgtccaatttgttcgccaatgtcttttgtttactagggtataagtgggaatatgtatctattgtagtcgtgatagaggcgtgtccaagacgttcttttacgactagataatcttccccttgattgataagtaaagacgcgtgagagtgccttaaatcgtgtattcgtatcttttttagatagtcgttcctagccagtatctgcttaaattttttatcaatcatattttttgtcattggtagtggtgtgctttgaattacttgaaggttttctgtatctgttgtaaattctttaagtaagtctttttgtttttctttccagtctgcaagcattcttgctaatttatgattgattgtaatacgtctggtacctgctctagtttttgtactattgatatgatttgtaccgttaacaaagtatgctgtttttgtgatgtgaatgctattagtgattaagtttatatcgtaccaagttaacgcaactatctcgcccaatcgcatgccagtaaaaaaggcaatcgtaaagaataggtcataacttatttcatcacttgtaataagttttctaaattcgttaaattcttctacattccaaaaatttatagttggcttactaataggtaattttcttatattttcaactggatttttatctatcaatgactttcttacaccagtatcaaaaatctttttgagaagtatcattattttattgactgtattatgacttaacgtagagctatcgttttgcttttttggctttattttgagatactctcgaaattcaaaaatgtgctcataagataatttgtttaagtttgtatttatgaagtaaggtttgatatgtcgctcatagttgtttctttgtgtgctgatataactgatttttctgttattttgtcggtcttcttcctcaagtatatcgaagagcatatcggttgttaccaaaaaatcaaaacgtttttcttttaactcaacaacacggatatattgttctaactctaaagcttctttcttggtcttgaaacctttacgaatgattcgtatccgctttttggtaactgggtggaagccgtcagaaatatcaacagtccaagttccattttttgctttcttaactgtcatgatgagcacctaaagaaacgtcaaaaccaagtaattcagtagcgatagaagcagggatagttccgacacgcttattttgataaaccctaaaccctcttgctattagaagctctttcccctgtctgatgatacgtttagaagttccttcagagaaaccaagggcaactaggtcattcttatttacggttgctatcattgaacactttcctttcttttgttataatctagttagttaatttttagaggcgacttgttttcaagtcgtctttttttgtccccataagggagaactattctgctctcgaatatattgctctatatccttttcatcattatcagttagccttgacaagccctcttttagtagaccttgaatgtagtcctctgccttttgaacatcataggcttgatattttgctgtatagacttttgccaatgtcttcgcaacttgtttctctgtccaagcctctgactgccgtaatgtaggcttagttctctcaacgctcaaaacagtctgattttcggtctttagatagtctagccaccacttgaccttttttcttctccaacgattagtatctgtcgcatttggtttcacaaaacgatagtgaccattgatagcttcaaaatagatagatgacagaggacgctttagaaacaattgctctgcaataatattcgccttatcctgccaacatctaagttccgcacgaatccatgagggatattctacaagctcttgcttgctaagttgttccatacgtttgttgtagatacaccattgttgattacctctggaacctatagcaaccgtctctccaactcgttctccattttctaagacagatttctcatgatactcaaaatgctttgctttcgagatacataaacctttcttgcaatagtcatatactcgctgaacatctaaactaccgtcaaatatgtcgtgagcaatatctaagcgagtaaaattaaccgaatactgatacaaccgacctatcaaagctatccaattattttcgttaccgtccaaaaattcttcatattggcgacaaccttgcccttttaattcgataaaaacccccattgaaggtctatcctcattaaagtacactttaatctcagaacaagcataatgtcgctggtacttgtttattccccaattatttaatgtgaaatcttctaaaggaattaaaagaatatcagttaaaacactttctggaggaatatttttaacggttactgcaaaataatcaattctgactgtattcatagggttatgctcctagaattttaatgtcctcacatactaatttaacacctgcccagttacttcgtgccatgttccaagctaaacgaactttcggcttaaccaactcaatcggaacattcaaaagtgattcattttgagcgagcgtagcaaccttatctacattacctacaatttctaggttgatagctttcaagtcatcagtagaaattcccatttcagttagaactttcactttatcggcatcaagggcagtacaagtgattttcgtaacttcttcagttttgattttctcgccattaacctcgttatacctattatttactttagcagatagaataacaatttttttaggcacttcaaactgtgtcatatccaaatcaagttgcccaatcttaagggtagtatctgtcatattgtaagtcataataattactccattttctattcaaaaagtcgtatcctacacgaaaagcgactaaatcccttctcccacaagggtttcaatgacttcggtataaccaacaagccgtaaccccttacgtatcaagggtttagagtacatttcatgtatgtgtgcaccccctattagagtacatttcatgtatgtgtgcaccccctattagtaatgggggtatttttctgacctcctgcaaagcagtcggttggctctttctcctagcgaaaagaggaacgctccgctcgattctgccccctgggcaatcgtcccccctatttcgctagtccgaaagaccgtcattattagtttggcagtatatttctaactacctgtaaaaaatcttgttttgttttaacatcgacgaacgggacgatagttagtacaggctcaacagaatttaaaccgtcagcataaaagagtgcttcgcctttcctgtctgaaattgtaggaacattttccagttcacacatactaaaagccattttcaatcggtcgtcccctatatttccgaggtataaaactgctgatatttggtttctaagttcaacaggaatattctctgcatttgggtcttgggtactaaggcagaggtggcaacctgcctgccgtcctttgcgtgcaatcaagcctaagttttgcagaatttcattccatagctctttaccttgtttactagaaccacaactatcacgaatagaagcaagctcatcaataaacaaaaaattaggggtcattcctaaatcataggcatcagcatttagcgaactgttctgcttgataacctcaaaacgttcatccataatttttacaaactgtcttgatagctttgctagtgaagtaggagaagagcctactgaaatttgttttcccagttcttcttggaggagtgccccaagagcatataagtcagctcctttaccatcaacgatagctagataagtatcaataccgcaccctttggcaagtgcattaaataagtaccattgtagagctattgtcttccctgtacccgtccttccatatactcctaaattagtattctgttttagagaaaattgctgagtattggatagtttaactattggcgtaggtatgtcttcaaaaaaatctctagtcaatgtttggctattgaatatatactgctcaatttcttctatctttccaagtttataaataacatggtcaggaaattcatatttggatagtagaggtagacccaaggttggaacaagatattcttcaagattttttagaagttttaaaaacttattcccaaacaatggtacttcgaccattacaatatcattgggcaagatttcaaagtttaatgttgcactattggttactacattatcactttcttcgtataaatttaggccaatcagcatatcaaatagagattctctaacatacagtatattttgaatttttgatataaaaacagacttaaaaaatttttcaatagaacaaattattccaataaatatcaatgaaagcactgatttaatagggattgagtatggagaaacccaagtgtttatcaataacattcctaaaaataaatccattccgactctgctcaaaaacaatcttttagaggttattatataaggattaaacctcactcgtactgcatgattcagcttgattagcttcattatctgtccctccgtggtcattttctgataaataacccaacaataacaataaaagtggaataactaaaaaacctccagctacaaacaaagtatcaaaccacggagacatcgtccctttcatctggaatataatatacaaagaaataactagagcaggataggttatgttgaacataaatttataaattttcataataatttcctttcataaaaccaaagggggaggggttagctcccccttatatcactaagcctcaattattgaggtgtaaaaagaagtttccctgtagccttggtaaatctctttgttcatcaagctaatcctaaattcatcagaaatacggtgtttttgacgattaagaataatgatgttttctgctaacttcttcaaagtaggctcatagattaccccttcaattggcaaattttcctttaaaaaatctctggattcatcatctaaggtaaagtttactgatttgtctgaattaaagctctgtactcgcttaattccattgatatttggcatttccattccttcgctaaggaaaatatctttaaatgttttcatctatttatttctccattttttattttgttgttacagtcaatattcttaaataaattggtgaagctctagccttcattagtattctcctctttgtgtttatgtataaatgtagtatcagtcataaacaacagtaattaagctacagttcctcaatgttaccatgagaaactgtaatcctctactgcattatttctttatagtaagcaaaaataacaagttttagaacatatgacaatctaacttgcctaaccatttcagaagtcataaattctttttgataactttccaatgatgtaataatagaattttccaaaaaaaatcttacagacaaggttccaacatccttatcctttggaatagacgaaatcgaatgtttcatttcattatctaatttatgccaatctttcaaacttaaagatttcgttttttcaaaagcctcttctaaaacacttgatgcagaggcttttaaaatcaaagtcactgaagttgcccctaattcattgtcaacttctttcaaatatgattttgttgcatgttctaaattttctatatcttgttcatttattttagcgtctaacttttcctgaatcactgcttgtattgattctaaccaatacttcgcttcgtaagatagacgtactccaaggtgtgagcgcatttttactcctattattagttttgttgtatttgatatacacattctatcatctatatttgcagaaatcaagtaaaaacaccaaaagatttccaaaaataaaatattctatttcctttacgacagaatggacgtcttaaaatattgatttaataggctttgagtagttgtaagttcttaagtatcaaactcaaaatccagtgtccgcaaggacgtgccggttcgaccccggccgccggtatagtttaaaagacaaggtttctaagccttgtctttttgttttgaggttataaaattttcagttgagttactaaaaattacttaatgttttgttgtataataagttatataagcaagaggaggagccattatatgaagacactttatcattatacaacagttgaaacattgcttctgatattaaattataaaacattgagattcaaaagtttactttatgttgacgatccattagaaccttcaacttcagactttggtaatctaggtggatttaagtatgtgtcttgttggactgatactcctaatagtattccacaatggacaatgtattctgataatatgacaggagtgtgtataggaattagttttgacaaagaaactgatgtctttttaacggaaaaattttctttatctgaatcttctgaaccaattgatatggtaaatgcattacatcctttaaaatcaggcttattagttacaaataataaatatgtgccttctttggaacaaataaggtatactgatgatgtttcattgatcactcctcgagtagtttcttcagatgataaatccacaactattaatttagcttcaaatggtatctataagacaactgattggagttttcaaaatgagcaaagattttcttttcaaatttttccattaccaatagatttagttttggaattaatgaatgcaaataaaggagatttgactgaaataattaatagttttatttctgttaaacctaaagaatactttgatttagatttaaatccgactatattcagtaatatgacaattacgtttggtaaaagatgctctgctgaagataagttgaaagtatcaaaatttttagaggataataaattccatattcctttatttgatagtactgtaaatataaagccttaaattaggtcatctaatttatctgctaaatctttttgcttgcttggatacaagtgagaataggtatcgattgaagttgttataaaagcgtgtcctagcctttctttcacaactaaataatcttcccctcgatttatcaatagagaagcgtgtgagtgcctaaaatcatgtatgcgtatctttttaagagccgcatcacgttcaagaatttttttgtactgcttttctattgaattttttgtaatcgtaatgggactactttgaaacactgacatcgaacagacattagctagagggctggctggactacagttacgaattgaacaaattattctggctcataacttacgctattttgaaatgaactagcaccacgggtggcttatacctttattaacgtatacagactttgtgatatgaattgtattgctcgaaaggtcaatgtcttgccatgttagtgcgagtgcttctctaagtcttagatctgtaaagaataggactgtaaagagtaatttttatttaccattttcaactaaactctttaattctaaatgtactttattgttctcaagttctaccttattttttcgtctcagtctagtttctagttctcgagtcagactagtacttactttgagaatttagcttttaaatattttccttgtttttttgttttctatgtggtatacttaacaagttaattaaaaggttaaggggatgcctatgaatcgtattgcattagaaattgagaagtacctgcacgagattgttttgagttcggagaatcaattagagattttggttggttcttgtcaaagcacggtgaagttgacgaatacgcaggagcatattttgatgcttattgaaaaggctgcatatactaatactgagattgctaaggagttgaatgttagtcaggctgcgatcacgaaggctacaaagtcattagttgctcaggggttattggtggcggttagagatgataaggatgctcgtattgttcgctttagtttgactgaggctgctaagcctattgctgcagagcatgctcatcatcacgcgcataccttggaagcttatgaagagcttttggaaaattatagtcttgaagagcaggagtcaattgctcgattcttaagtgagttagtggagaagattagaaaatagatgagatatattactgtggaagacttgtcgttttactacgacaaagaaccggttttagaacatattcattattatcttgatagtggggaatttgtgactttgactggtgagaatggcgcagccaagacaaccctcattaaggcgactttggggatattgaagcccaaacaagggaaggtttctattgctgagaagagtataaaggggaagaagttgagaatggcctatttacctcagcaaattgcaagttttaatgctggttttccgagcacggtttacgaatttgtaaaatcagggcgttatcctcgacaaggttggtttcgtcgtttgacagctcatgatgaggaacatgttcggattagtttggaatcagttggaatgtgggaacatcgggataagcgcttaggtgctttgagtggtgggcagaagcagcgtgcggtcattgcgcgtatgtttgcctctgatccagatatttttattctggatgaaccgacaacagggatggatgcagggaccaaggatgctttttaccaactcatgcaccattcggctaagaagcatggaaagtcggttttgatgataactcatgatcctgatgagctgaataagtatgctgatcgaaacattcacttggttcgtgatcagcagtctccttggcgttgtttcaatgttcatgaagcggatgaggaggttgcccatgtttgatctatctgtatttcattatgactttatgcagcgtgctttcctggcaatcattgcgatgagtctgttctcgcccattttgggggtcttcttgatactcaggcggcaaagtttgatgtcggatactcttagtcatgtttcgttggcgggggttgcatttggtttggtattggggatttcaccaacgctttcgactgttcttgtcgttattgtggcagctgtatttttagagtatttgcggacaatttacaagaattttatggaaattgggacggctatcctcatgtcgactggtttggctatttcgctcattgtcatgaataaatctggtgggaaatcagggcttagcctggaacaatatctgtttggttcgattgtgacgattagtcaggagcaggtaattgctttgtttacgattgctgtgattgtcatcgtgctgacattgttgtttttacgtccgatgtatattcttacctttgacgaggatacggcatttgtagatgggttacctgtgcgagcaatgtccattgccttcaatgtggtgactggtgtcgccattgccttaatgattcctgcggcaggtgctttgctggtttcaacaattatggttttgcctgcttctattgcattgcgacttggtaagagctttaaagctgttatctttactgggatgggtattggcttttttggaatggttatggggttgctgacttcttactatgcagaaaccccagcgagtgcaagtattaccttgattttcattagtattttcttactggtgaatgttgttcaaaaatttaaaaaataaggagttaagatgaaaaaagttggtttattattcttgtctgtctcagctttgcttttgggtgcttgtggcaatagcacagcttctgaagatgggaagttgaatattgtaacgaccttttatcctgtttatgagttcaccaagcaggtggcaggtgatgaggcaaatgttgatctgttggttaaggctgggacagaggttcatggttatgagccgtcagccaaagatattgctcgtatccaagaggcagatgcttttgtttatgaaaatgaaaatatggaaacatgggtccatgatgttgaaaaatcacttgatacaacaaaggttaatgtgattagtgcgacggaggggatgttgcttttgcctggtggtgaggaggaacatgaaggtcacgaccatagtgaggaggggcatagccatgcttatgacccgcatgtatggttgtctcctgagcgtgccatcacacttgtagaaaatattcgtgatagtttggtagctaaatacccagaaaagaaagatgcttttgaaacaaatgcggcagcctatattgagaaattagatgctttggatgctaaatattctgaaacattatctgctgcgaaacagaaatactttgttacacagcatactgcatttgcatatttggctttggactatggtttgaaacaagtttctattacaggtgttgctgcagatgaggatccaactccatcacgtctagcagaattgacagagtatattaataaatatggtattaagtatatctattttgaagaaaatgcgtcaaaatctgttgcagaaacacttgccaaagagactggggttcagttggacgttcttaatcctcttgaaagtttgacggatgaggatatgaaaaatggtaaggattatatttctgttatggaagataatctgattgcccttgaaaaaacaacttcccaagaaggttctgaaattttgccagaagaaggtgctgagactgcgcaaactgtttataacggttattttgaagatagtgccgtaaaagatcgtactctttcagattatgcaggtgagtggcaatctgtttatccatacttgcttgatggtacactagatcaggtctgggattacaaggctaagatcaaaggtggtatgacagctgaagagtacaagacttattacgatactggctacaaaacagatgttgatcaaattaacattacagataataccatggaatttgtagtgggagataagaaagaaaaattcacgtataagtatgtgggttataagattttgacctacaaaaaaggaaatcgtggtgttcgtttcttgtttgaagcaactgatgcaaatgctggtaactataagtatgttcaatttagcgaccacaatatcgcccctgttaaaacaggtcacttccatatctattttggtggagagagccaagaaaaactcttggaagagttggaaaactggccgacatactaccctgttggtttgactggtttggaaattggtcaggagatgctggctcactaagaataatgagaagactgggcaaggtgttcagtctttcttcttgacaatttttgactacaaatgtaaactgaagttagaaaattattgttgggaggtgaatgtgtggagcagacaatttctgctgcggagtggcaggtcatgcgggttctgtgggcccatcctggtgcgacttctcaggaaattattcaggccttgcaggaaggctttgattggcaggcgacgactattaagacacttttagggcggctgcggaagaaaaactatttgagaatggctaaggaaactagcaagtaccactattatccgctgattagtgaagaggaacatttgcaggggcaggtggagctcttactagctgccatatgttccacaaaacaggggcaactggttgaaaaactgctagacacagggacattttccaaaaaaagcctagaaaatctggccagcaaaatctcgcagttacaaaggactgcacctgagcaaatcgcttgtcggtgcttggctgggcaatgtacctgcgggcatcatcatactcttcgaaaatcaacctcagacgttgttgacttgacttgatgagtgtaaagctcctgtggagctttacagcctactacctgaaaatgcgaaagtagtagggttctatctgctcttggagaaacgaagacgttcgctttatttccaaccttcaaaggttccccgaacctttgaagctagtctgaatctgattttcattgagtataaaaaaggagaaagaacatgaagcaaactttgaaattgaaaaacttatcgtgccaaaactgtgtcaagcatgtgaccaatcacctcttggacttggatggggtggaagaggtgaaaatccagctggaagagcagttggcggaggtggcaacctctgtggcctatgacttggaacggtaccaagaggtgctggaagatactatctatgaagtggaagagttggtataagcgaaaaagcagccgtcgggctgctttttataatgctttgagaaaatgagtcaggtctagttgcgcttgtgcaagtgaaatttggtcccagaagccgtctgatcgaaagcgtggaattaggtggacatggaaatgggtgccagcattaaacaagcgatcgttgcaggctgtggtcacaccgtcaattgccaatgtttgacagagtttttcagtcaaaaatacttccaagtccgatagttcatagcgaatagtaggtgggacttgactgagtgtgtcatagtggtctttgctgataatcaacagatgcccagtttgaatagggtcaatgtcccagaccaccttgaaatattctgtctggtagagaatatctatttcttcaatctgatggcaaaaaatacaggtcatagctgttctcctattgatagaacaaaaggaaatcatggtggatttccttgaaaaatcttaataagtcaacacagaatacttcttcttcccacgacggataacggttaactcgccgtcaatcttgtcactgtcagaaagggtatagtccaagtcttgcacacgctcaccattgacataaatggcaccattttgtacatcttcacgagcttggcgttttgaattgacaataccagaggtaactagaagttccacgatgttaaggttgtcttcagcctgtacagcgtagtttggaacgttgctgaggccttgtttgagttcttttgcggataggtttttgatattgccagcaaacaattgctcggtgatgttaagggcttggttataggcttcttcaccgtggaccaatgtcacgacttccttggccaaaatcttctgagccaggcgttcatgacgggcagcgtcaaattgtttctcgatttcagcaatctcatctaatgacaagaaagtaaagattttcaagaaacgaacggcatcgtcgtccatgacattgagccagaattggtacatttcatacggagaagtcttgtcggcatccaaccaaacggcgttgccttcagacttaccaaatttcttacctgttgagtcggtgataagtggcacagtcatcacgtgaccagacttgtcagccttgcggcgaagcaattcagtacctgcagtcatattgccccactggtcagaaccaccgatttgtagggtcacattgtgcttgtcattgagctcgtagaagtcatagccctgcatgatttggtaggcaaactcggtgtaggaaatccctgtttcaatccgtttttttacagagtctttgctcatcatgtagttgaccgtgtagtatttaccaacatcacgaaggaagtcgataaagctgatgtctgagaaccagtcgtagttgttgaccatttcagccttgttgtcaccattttcaaaatccaagaagcgagagagctgaccttggatttttgttacccagccgtccacggtgtctttggtttgcaagctgcgctccgcatccttgaaggaagggtcgccaatcagaccagttgcaccgccaactagggcataaggcttgtggcctgctaactgcaagcgacggctagttaagatagcaaccaagtgccccaagtgtaaactatctgctgttggatcgtatcctgtgtaataagaaacctgtccttctgtcaatgcttttaccaaggcttcttcgtctgtcgtttgaaagaccaagccacgagcttttagttcttcaaaaatgttcatgtgggctgtctcctttaggtttaatatacaggaccataaaccattttatatgatttttggaccgaacttcattttaaaaaattcctccctattataccacgaaattgcggaaaataaacaaaatttggtataatggaacgataaggagttaatatggcgactaaatcagataagcaagattttaaaaagaaaatcagtgccctaggcttaggggatgtagtaggagttttccttcggacgctgaaattattattcaattcagtagctgtcttggtgttcctattcggtctttttggtgcgggtataggaattggtttcgtggttagtctttttgatgacgttaagattcccaaaacagaggaactggtagcgaaggtttcagaagttagtcggatttccaccgttacctattcggatggtagcttggtgtcggaagttaattcagatctgcttcgtgtacctattacttcggaagaggtctctaattatctaaaacaggctgtaattgcgacagaggatgaaacatttgaaacccacaatggggttgtgcctaaggctgttttgcgtgcggcactgggatcagttggtctaggttcatctagcggtggttcaaccttgacgcagcaattgataaaacagcaacttgtcggagatgctccaacctttacgcgtaaggctaatgagattgtttcggctttggcattagagcggaatatgaccaaggaagagattttaaccatttacttaaatgtttctccatttggtcgaaataatcagggacgaaatattgcaggggtagaagctgcggctcagggaatttttggtaaaccagcgaaagacttgactgttcctcaggctgcttttattgcaggcttaccgcaaagtccgattgtttattctccctatgcatcagatggaacacgtaaatcagatgaagatatggtttacggtattgaacgctatcaagatgttctctttaatatgtatcgggcgtcattcttgaccaaggaagaatacgaaacctataaagcctacgatattaaacaagattttattgctccagctcctgtaatggcggatacgaaagattatctctattacaaggtcatggaagaagcgcaagaggttatgtttgattacctggtgaaacgtgacaaggtttctaaaaatgacttgaaaaatgatgaaacaaaggcatcctatgaggagttggccaagcaagaattgagccaaggtggctacacgattaagagtaccgttgatcaaaaaatctatgcggcgatgcagtctgttgtggcaaactatggatctgttttggatgatggaaacgaatatgtcgagacaggtagtgtgttaattgataatgccacaggggccattttaggatttgtgggtggtcgcgactatgcaaccaaccaaaataaccatgcctttgatacccttcgttcgccagcgtcaaccatcaagcctctgttagcttacggtattgcgattgatcaaggtttgataggttctgccagcatcctttcagattatccaacgaacttttcaagtggacaaccgattatgtatggttcaggacgtggtactggtatgatgaacttacagacggctattgaccgttctgttaacattcctgctttttggacctataagatgatgagaaatgcaggtgtagatgccaaagcgtacatggataaaatgaattatcatattcctatgtacgatattgaaagtgtaccgttgggtggtggtgttgaaatttcagtattgacaaataccaatgcctatcaaactttggcaaatggtggcgtttataacaaacattacattgttgaaagcattactgcctctgatggaacagtagtgtatcagcatgaagcgactccggttcaagtctattctaaagcaactgcaagtattatgaaccagcttttgagacaggttgtcaactctggttatactacgacgttcaagagtcgattgagtggtttaaacccacaggcagcatcatctgatttcgtcggtaagacgggaacaagtaatgaagtcaatgacgtgtggctcatgctatcaacccctagagtaactttaggtacctgggctgggaatgatgataactcagaaatgtatgtctggacaggctaccacaataattcacaatatgtggcccatatggttgatgcgctttacaatgttaatgcggatatgttcgcaggaaaatttgaattagacagtagtgttattgcttctagcgtcgttgcttctacaggtcaacgtgcagggacaacacaggtaaatgggcgccaagtaacagttggcggtgcgatgacaactagttattgggctaaaaatggtgcaccggtaacgagctataacttcatggttggggggacagatagtgatcgagcacaggcttggaatacaattatcggctcccaaacggcaacatcaagtagctcaacccaacgaagcagttcgactcggagtagcacgagttcttcagctaataacacgaaccagtcatcagaaacgcaaacagcaactagtgagcaagcgaataatgattcaccttgatttttcctagtacttgtgctataatggtataaattatttgtcgtgtgtcttgtttgaaatattgtccaaacaaggcttgcagcagttaaatcaaactttttcaaaggaagatttagctgctctttttgtgtctatgaggaatttttttgagaattgttacctattcttaaagattctaaaaattcagaaaaaggatgaatgttggtcatcacatggctgtatataattgaactcgacctaaaacctgtgtgaaaaagtgtatgaaatatttactttggtttgtcactcccaacgtcgtaaacgtctggtctttcttcgacattctgtctagaaagccctagtcgttctgacgagggtgcgttaacgaaatcaaagatttcggacttaccgcttattctcactttggttttcacggtctcgtatcttattacaaaggagaaaacttttggcaggacatgaagttcagtacggtaagcaccgtacccgtcgtagtttttcaagaatcaaggaagttcttgatttaccaaatttgattgaaattcaaacggactctttccaagactttttagattacggtttgaaagaagtctttgaagatgtacttccagtttcaaactttacggataccatggaattggaattcgttggttatgaattgaaagagcctaaatacacattggaagaggcgcgtgcgcatgatgcgaactactcagctccaatttatgtaactttccgtctggtgaataaagaaactggcgagatcaagacacaagaagtcttcttcggtgagtttccaatcatgactgaaatgggtaccttcatcatcaacggtgcagagcgtatcatcgtttctcagttggttcgttcaccaggtgtctacttcaatgataaagtagataagaatggtaaagtaggttatggatcaacggttattcctaaccgtggagcttggctggaattggaaacagactcaaaagacattgcctacactcgtattgaccgtacgcgtaagattccgttcacaacgcttgttcgtgcgcttggtttctcaggcgatgatgaaatctttgacatcttcggtgatagcgaattggttcgcaataccatcgaaaaagatattcataaaaacccagcagattctcgtacggatgaagcgcttaaggaaatctatgagcgccttcgtccaggtgaaccaaagacagctgaaagctctcgtagtcttttgacagctcgtttctttgacccacgtcgttacgacttggcacctgttggtcgttataagattaataaaaaactcaaccttcgtactcgtttgctcaaccaaacacttgctgagcatgtgattaacggtgagacaggcgaaattgtcttggaagctggtactgtcttgagccgtgacgtgcttgaaaaagtagaagcacaattcgatgagctcaacttggtagaatacattccaaatgacaatgctgttcttcttgagccagttcttttgcagaaattcaagattgtagctcctaaggatccagaacgtgttgtgacggtgattggtaatgctaatcctgcagaaaacgtacgtacagtaacacctgcggacatcttggctgaaatgagctacttcctcaacttggctgagggtcttggtcgtgtagatgatattgaccacttgggtaaccgtcgtattcgtgccgttggtgaattgcttgctaaccaagtacgtatcggtttgactcgtatggaacgtaacttgcgtgagcgtatgtctgttcaagacaatgaagtattgacgccacaacaaatcatcaatatccgtcctgttacagccgcaatcaaagaattctttggttcatctcagttgtcacagttcatggaccaacacaacccactttctgagttgtctcacaaacgccgtttgtcagccttgggacctggtggtttgactcgtgaccgtgctggttatgaggttcgagacgttcactacactcactatggtcgtatgtgtccgattgaaacgcctgagggaccaaacatcggtttgatcaacaacttgtcttcttatggtcacctcaacaagtatggcttcatccaaacaccataccgcaagattgaccgtgcaactggtacagttacaaatgagatcgtttggttgacagccgatgaagaagatgcttatattgtagcccaatcaacatcgccacttgatgaaaacaaccgtttcgttgataagattgttatgggacgtcaccaaggtaacaaccaagagttcccagcagattcagcagatttcatggacgtttcacctaagcaggtagttgccgttgcgacagcatgtattcctttcttggaaaacgatgactccaaccgtgccctcatgggtgccaacatgcaacgtcaggctgttccattgattgatccaaaagcaccttacgttggtactggtatggaataccaggctgctcacgactcaggtgcggcaattatcgctcaacacgatggtaaggttgtttacgcagatgcggacaaggtagaagtgcgtcgtgaagatggctcgcttgatgtctaccacatttctaaattccgtcgttcaaactcgggtactgcctacaaccaacgtacccttgtaaaattgggcgacatcgtagaaaaaggcgacttcatcgcagatggaccttctatggaaaatggggaaatggctcttggtcaaaaccctatcgttgcctacatgacgtgggaaggttacaacttcgaggatgcggttatcatgtctgaacgccttgtgaaagatgatgtctatacatctgttcacttggaagaatacgaatcagaaacacgtgatactaagttaggccctgaagaaatcactcgcgaaattccaaacgttggtgaagatgcccttcgcaacttggacgaaatggggattatccgtattggtgccgaagttaaagagggcgacattcttgttggtaaagtcacaccaaaaggtgaaaaagatctttctgctgaagagcgtctcttgcacgcaatcttcggtgacaagtcacgtgaagtacgtgatacctctcttcgtgtacctcacggtgccgatggtgtcgttcgtgatgtgaaaatctttactcgtgccaacggtgatgaattgcaatcaggtgttaacatgttggttcgtgtttacatcgctcaaaaacgtaagatcaaggtcggagataagatggccggtcgtcacggtaacaagggtgtcgtttcacgtattgtacctgttgaggatatgccatatcttccagatggaacaccagttgacatcatgttgaacccactcggggtgccatcacgtatgaacatcggtcaggttatggaacttcacttgggtatggcggctcgcaacttgggcatccatatcgcaacaccagttttcgatggtgcaagttcagaagacctctggtcaactgttaaagaagcaggtatggactcagatgccaagaccattctttacgatggacgtacaggtgaaccatttgacaaccgtgtatctgttggtgtcatgtacatgatcaagcttcaccacatggttgatgataaacttcacgcccgctcagtcggaccatactcactcgttacccaacagccgctcggaggtaaggctcagtttggtggtcagcgtttcggtgagatggaggtttgggcccttgaagcctacggtgcttcaaacgtccttcaagaaatcttgacttacaagtcagatgatgtgacaggccgtctgaaagcctatgaagccatcaccaaaggtaaaccaattccaaaaccaggtgttccagaatcattccgcgttcttgtcaaagaattgcaatcacttggtttagatatgcgtgtccttgatgaagacaacaacgaagtagaattgcgtgaccttgatgaaggtgaagatgatgacatcatccacgtagatgatcttgaaaaagcacgtgcaaaagccgcagctgacgcagccgcagcctttgcagcagaagaagcagaaggcaaagaataattagaatggatggaacaagttggtccaaacctcagaactgaaagagataagggccaacggtcttccaccgtctgatttatagaaaaatagcttaccagctatccattctgctgattattgttcaagaatttgaggtatgggaatccatcctctcacaagaaaagaaagggattattagtggttgacgtaaatcgatttaaaagtatgcaaatcacgttagcttcaccaagtaaggttcgttcatggtcttacggtgaggttaaaaaacctgaaacaatcaactatcgtacacttaaaccagaacgtgatggactttttgacgaagtcatcttcggtccaacaaaagactgggagtgttcatgtggtaaatacaagcgtatccgttataaagggattacttgtgaccgctgtggtgtagaagtgactcgtgcaaaagtacgtcgtgaacgtatgggacacattgagttgaaagcaccaatttcacacatttggtatttcaaaggtattccaagtcgtatgggcttgaccttggatatgagcccacgtgcgcttgaggaagttatctacttcgcagcttacgtggtgatcgatccgaaagatacaccgcttgagcacaagtcaatcatgacagagcgcgaataccgtgagcgtttgcgtgaatatggttatggttcattcgttgccaaaatgggtgcagaagcgatccaagacctcttgaaacaagtcgatcttccaaaagaaatcgcagctttgaaagaagaattgaaaacagcttctggtcaaaaacgcattaaagcagttcgccgcttggatgtattggatgctttctataaatctggtaacaagcctgagtggatgattctcaatatccttccagttattccaccagatttgcgtccgatggttcagttggatggtggccgttttgccgcatctgacttgaacgaactctaccgccgtgttatcaaccgtaacaaccgtttggctcgtctcttggaacttaatgctccaggtatcatcgtacaaaacgaaaaacggatgctccaagaagctgtggatgctttgattgacaacggtcgccgtggtcgtccaattacaggaccaggtagccgtccacttaaatcactcagccacatgcttaaaggtaagcaaggacgattccgtcaaaacttgcttggtaagcgtgttgacttctcaggccgttccgttatcgccgttggtccaactcttaaaatgtaccaatgtggtgtaccacgtgaaatggctatcgagctcttcaaaccgtttgtcatgcgcgaaatcgttgcccgtgatattgctggaaacgtaaaagctgcaaaacgtttgattgagcgtggtgatgatcgtatttgggatatcttggaagaagtgatcaaagaacacccagttcttttgaaccgcgcacctacccttcaccgtttgggtatccaggcttttgagccagttctaatcgacggtaaagcccttcgtttgcacccgcttgtctgtgaagcctacaacgccgactttgacggtgaccagatggcgattcacgttccattgtcagaagaagcacaagcagaagcacgtatccttatgcttgcggcagaacacatccttaaccctaaagatggtaaacctgtcgtaacaccatctcaggatatggttttgggtaactactacttgaccatggaagatgctggtcgtgaaggtgaaggtatggtcttcaaggatgcggatgaggctgttatggcttaccgcaatggctatgttcacttgcatactcgtgttggtatcgcaacagatagcctcgataaaccttggaaagacaaccaaaaacacaaggtcatgatgacaactgtcggaaaaatcttgttcaacgcaattatgccagaaggtcttccatacttgcaagagccaaacaatgctaacttgacagaaggaactcctgataaatacttcttggaaccaggatcagatattaaggctgccattgcagaattgccaatcaacccaccattcaagaagaaaaatcttggtaacatcatcgctgaaatcttcaagcgtttccgtacaactgaaacatcagcccttcttgaccgtttgaaagacttgggttattatcactcaacactcgctggtttgacagtgggtattgccgatatcccagttatcgacaacaaggctgaaatcattgaagaatctcacgaacgtgtagaacaaatcaagaaacaattccgtcgtggtatgattactgacgatgagcgctatgcagctgttacagatgaatggcgttcagctaaggaaaaattggaaaaacgcctggttgaaaaacaagatcctaagaacccaatcgttatgatgatggactctggtgcccgtggtaacatctccaacttctcccagttggccggtatgcgtggtctgatgtcagctccgaacggacgtatcatggaattgccaatcttgtctaacttccgtgaaggtctttcagtattggaaatgttcttctcaactcacggtgcccgtaagggtatgacggatacggccttgaagacagccgactcaggttacttgactcgtcgtttggttgacgttgcccaagacgttattatccgtgaagacgactgtggaacagaccgtggtcttgacatccgttcaatcacagatggcaaggaaatgatcgagccacttgaagagcgtttgcaaggtcgttacactaagaaaactgttaaacatcctgaaacgggtgccgttatcattggtccaaaccaattgattacggaagatattgcccgtgaaattgtcaatgcaggtgttgaacaagtaaccatccgtagcgtatttacatgtaacactcgtcacggtgtctgccgtcattgttatggtatcaacttggcgacaggtgatgcggttgaagtgggtgaagcagttggtacaatcgctgcccaatcgatcggtgagcctggtacacagcttacaatgcgtaccttccacacgggtggtgtagcctcaaacagcgatattacgcagggtcttcctcgtgtccaagagatctttgaagcccgtaacccgaaaggggaagcggttatcactgaggttaaaggtgaagttatcgctattgaagaagatgcttctactcgtaccaagaaagtctttgttaaaggtaaaactggcgaaggcgaatatgtggttccatttacagcccgtatgaaggttgaagttggggaccaagtcgcgcgtggagcagcccttaccgaaggttctatccaaccaaaacgcttgcttgaagtccgtgatgtcttggcggttgaaacttaccttctttctgaagttcaaaaagtttaccgtagccagggtgtagaaatcggcgacaagcacatcgaggtaatggttcgtcaaatgcttcgtaaagttcgtgtcatggatccaggtgacacagatcttctcatgggtaccctcatggatatcacagactttacagatgccaatgcggaagtggttattgcgggtggtattccggcaacagctcgtccagttcttatgggtatcacgaaggcttcccttgaaaccaactcattcttgtctgccgcatccttccaagaaacaactcgcgttcttacagatgcagctattcgtggtaaacgtgacaaccttctcggtcttaaagagaacgttatcatcggtaagattatcccagcaggtacaggtatggcccgctaccgtaatcttgaaccacaagccatcaatgaagttgaaatcattgaagacacagtagcagaagagcttgctgcagaagcagagcttgaagctgtaactgaataaattaagatggcacatctctctctttgagggatgtgtttttgatattcggaaagaaaccatatatatgacttgataaggaattaacaagcagaatgttttcttaaatcatacaatttcgatataatgtgtacgaaaaaggaagtaatattatgtatcaagttattaaaatgtatggagattttgaaccctggtggttcttagatggttgggaagaggatgttaccagtagggctgcttttgatcgctatgaggatgcactgaatgcctttcaaaaagagtgggtacggctatcagaggattttccaatgaagaaaagtaagaatggaacgatggtggctttttgggatgaatcagaccagcattggtgcgaggaatgcgatgaatatttgcagcggtatcattcgctgatgttggtagaagcgagagaaaatttaccggctggttttattaagcaacctacgcaacctcgtgtacgcccctgcaaattaaaacaaaataattgcgtaaatgaataataaaagaggattgacctttgcgggtcaatcctttttagctgaatctgatagtaaatgcttccgcatcaagttcaacatgctcgccaatccgaatggtaaacagaggctgggtatgggcaaagtccaaatcatagagaacagggctggttttgagagtagggtgcttgtccaaaatcgccagcaaaatctcctccgtcatcttggtctctttaggaaaacgaccgaagacaagagcctgtggatttggataggcttgtaaaagtgcagtcaagtgacgagcgataatgagataatcgtcgtcttccgcctcctctaaaaatagaatatattcgtctggtctgggagcaaactctgttccagtcagtaggttgagatatttccaccaatggcaataccagaggcctggcctggattgtagactttccattctgttgggtaaaaggtgcgaggggcgtctggtaggtaccaagcgtcgctagaccattctggactcggggtcaagtcaaaggagtcttgtgtcacagccttgagccaggcctgagtctggtaatcttgtccctcacgcatcttaaagctgctatagaatggtcccatgtaagtctgtatacctgttttggcatagatggcattgagcagggcagttgtgtccgaataaccacagaaaatctttggattgcgggcaattatgtcaaaattcaaataaggtaatagctcattgcagttgaaaccaccaatggttgtcaaaatggcatcgaccgactcatccgcaaaggctgcttccaagtccgcaacacgactggcaatcggagccgaatcgaacatatcattttcaaaataatgttctgagaaagagagtttgaagcccagattttctagtttttccttggcggcaagattggcctcaaaaccaccaactctttcgatagaagatgacgggctgacaatgcgaatatggtcgcctttttttaattttttcataggaagctccaagcttttttattattttaacaaaaaagtatggaaaatcaagtctccttacgaattgatagggtgaggaggttgtatgattcaagaaaaagcaagaaagatgattgaagaggcggtggcggatagggtcagtgacatttatctggttcctcgtggtgagtgttaccaagtctatcatcgtatcatggacgatcgggaatttgtgcaagacttggctgaggaggaagtaacagccatcatcagccatttcaagtttttagcaggtttaaatgttggcgaaaaacgccgtagccagcagggttcctgtgactatgattatgggagcggagagatttcacttcgcttatcaactgtcggagattatcgtggcaaggaaagtttggttatccgcctgctctatgacaatgacaaggaactcaagttctggtttgaggcggccgagcggcttgcagaagaaatcaagggacgagggctctaccttttttcgggtccagtcggctctggtaagaccacacttatgtaccatcttgctaggctgaaattcccagacaagcagattttgaccatcgaggatcctgttgaaatcaagcaggaggacatgctgcaactccagctcaatgaagccatcggagccacctacgacaatctgatcaaactgtccctccgtcatcgaccagacttgctcatcatcggtgaaattcgggatgcggaaaccgctcgagcagtcattcgagccagcctgacaggagctaccgttttctcaacagttcatgcaaggtctatttcgggtgtctatgctcgtatgttggaattgggtgtcggtcctgaggagttaaacaatgcccttcaaggtattgcctatcaacgtttaatcgggggaggaggtgtggtagattttgcaaagggaaattaccaaaaccattccgcagaccagtggaatgcgcaaattgatcggctttttgcagcaggacatatcagtcttcggcaggcagaaacagaaaaaattacccttggctcgccagcgtaaggtcattgagcttttcaataatctttttgccagtggttttcatctgggggagattgttgatttcctcaaacgcagtcagcttctggcagatccctatacccaggtcttgtcagacgggttgctggcaggcaaacccttttcgagtttgctggcagatttgcgattttcagatgcggtggtcacacaggtggctctagcagaagttcatggtaataccagcctgagtttgattcatatccagtcctatctggaaaatgtcagcaaggttcgtaaaaagctgattgaggtggcgacctatccgattatattgcttggttttctgcttttgattatgcttggcttgaaaaactatcttctgccccagttggaggaaggcaatgcagcgacagtgctgattaatcatctaccgaccatctttttatctctaagtggacttagtttggtggcggtcttagctggtatggtttggtttcgcaaaaccaataaaattaaggtcttttcctgcttggcagctctgccatttttcggaaaactcatccaaacctacctgacggcctattacgccagggagtgggggagtttgattgggcaaggcttggacctgccgcagattgtgggcttgatgcaagagcagcagtcgcagctttttcgggagattggccaggacctggagcagtcgctttccaatggtcagagttttcacgaacacattaagacctacgccttttttaagcgggagctgagtttgattgtcgagtacggtcaggtcaagtccaagttgggtagcgagttgacagtttatgcggctgaatgttgggaggattttttctctcgggtcaatagagccatgcagctaatccaaccgctggtctttctctttgtggccttaatggtcgttctcatctacgcagccatgttgctgccgatttatcaaaatatggagttgtaaaatgaaaaaattagttgaaatgaaggtaaaagggttcactctggtggaaatgttggtcgttttagggatcattagcctgctcttgctcctctttgtgccaaatttgagccagcagaaggatgctattcagaagaagggggatgcggctgttgtcaaagtagtggagagtcagatggagctctatgaattggaacatgacgaggaagcaacggtggcagatttgcaggcgaaaggttatattactgaaaaacaagcaaaacagtatgctacggcgaaaaaataaggcttttaccctgtttgaaagcctgctgaccttgttggttgtcagttttttagctgtttccttatcaggaacagtacaaacggtctttcggtctgttcaggaagaaatttttctctgggaatttgaggccatctataaagacagtcagaaattagcagccagttcccacaaaaaagtgaaccttgctatcggtggacaggaggttacaaatggttatcaggctgtagaggtgcccagaaacgtagaggtcttagaggagaaaactattcagtttgaagaagatggtggaaattcttctctgaccaagattcgttttcaccttagtcaaaaaatagtcacgtatcaattatatatagggagtggtcgctataagaaaacagaagaataaggcttatattttgctagaaagtctggttgcccttgcgactctagtgaccatttgcagcttgattttatcagctgtggatgcaggtcgtaggcgacaggtttgggaattggaacaacaggaggttttcaacttagcacagatggctgtccagacaaaacaagatgacctagccttaaacggagttgcagttcaggttcaacgaactgcggaaagagttgcggttttccatgaaggaaaggaggttttatcggttgttaaaaagtaaaattcctgcttttacactcttggaatgtttggtggttctagtcattctgtcaggtagcctcttgatttttgaaggcttatccaaattactagtccaggaagcgcattatcaaggtcagaccgttcaaaaggaatggttggtcttctctagccaattgcggtcggagtgggaccaggctgaattggtcaaggttgaaaatggcaaggtctatgtcaacaaaggtgaacaggctttggcctttggcaagtcatggtcggatgattttcggaaaacaaatgatagaggccagggttaccaacccatgctctatcaggtggatagcgcagccatttcccaagaaaaccagctggtgcgcatcgactttagctttaaaaacggagaggagcgaacctttatctatgcttttaaagaaaaaagttaaggctggcatcctactctatgcccttttgatgctggctgtttttagtctcttgcttcagttttatctccaccgccaagaggctgagagtcgcttggtacaggtggcaaggcaagaaacgactgcttatatcatggctcagatggtcttggacaaggtcgagcaggacctgcaagtagaaaaaatagttacgggagcggtagtgaatgaaaaggaagcaaatttaaccacaggttctaagcagaaggagaatagaggaagggtctcctttcaagagggacaggctcgttatcaacttaaaggagaccaactattggttacagttgagttaacaagtgatggtctgtatacctatcaatttccttttgggctatcatcagaaggagggtgagttgactcgttctcctttttagtgcaaagtctgtgaaattttgataagataggagtatgaattttgaaaagatcgaacaggcttacgacctgctattagaaaacgtacagactatccaaaaccagctaggtactaatatctatgatgccatgattgagcaaaatgctacttacgtagctggtcagcatgagacggatcttgttgtcaaaaacaatcagaccttgaaacaactagatttaaccaaggaagaatggcgtcgtgcctatcaattcttgctcatcaaggccaatcagactgagcccatgcagtacaatcaccagttcacaccagactctatcggatttatcctatcttttctagtagaccaattggtgccgactcaaaaggtgacggttctggaaattggttcggggacaggcaatctagctcagaccattctcaacgccagccagaaagaattggattatttggggatcgaagtggacgacctcttgattgatttgtcggcaagtattgcggatgtcatgcaggcagatatttcttttgctcagggagatgcggtacgtccgcagattttgaaggaaagtcaagtaattttgggagatttgcctattggctactatccagatgaccagattgctagccgttatcaggtcgccagtccaaaggaacatacctacgcccatcatttgctcatggaacaatccctcaaatatctggaaaaagatggctttgcgattttgttggctccaaatgatttattgactagtccgcaaagcgatttgctgaaaggttggttacaggagcaagccaatattgttgccatgattgccctgccaccaaatctctttgggaagactgctatggccaagtctatttttgtcttgcaaaagaaagctgcaagatcgttgacgccgtttgtttatcccttacaaagtcttcaagaaccagaagctattcagaagttcatgctcaatttcaaaaattggaagcaagagaatgcaatttaagtgaaaatctgttatactagttaggaaaacgctttaaaagaggtaagatatgtcaaaaacaattgcaattaatgcaggtagttcaagtctaaaatggcaactttatcaaatgccagaagaaacagtactagcagcagggattattgagcgcatcggtttgaacgattccatctcaacagttaagtatgatgggaagaaagaaagtgaagttttagatattcctaatcatacggttgcggttaagattctcctagaagacttgcttaaacacaacatcatcgctgcttacgaggaaattactggtatcggacaccgtgttgttgcaggtggagaatacttcaaggagtcagcggttattagtcaacaagagattgagcaaattgaagagttgagtgccttggcaccacttcataacccagcacacgtggcggcgatgcgcgcatttgaagaagtattgccagaggtgttgaatgtagctgtttttgacactgctttccatacaacaatgccaaaacacgcttatctctatccgattccacaaaaatattatacagactataaagttcgtaagtatggtgctcatggaacgagccactactatgtagcgcatgaggctgcaaaagttttggggcgtccaatcgaagagttaaaattgattacggcacatatcggaaatggtgtatccatcactgctaactatcatggtgaatctgtggatacttcaatgggcttcacaccactagctggtccaatgatgggaactcgttcaggggatattgatcctgctatcattccttatttgattgcgaatgttgaagaactgaaagatgctgcagacgttgttaacatgttgaataaacagtcaggcttattcggtgtatctggcttctcaagtgatatgcgtgatattgaagcaggtatccaagctcacaatccagatgcagtgttggcctacaatattttcattgaccgtattaagaaatttatcggtcagtatcttgcagttttaaatggggcagatgctattgtcttcacggctggtatgggtgaaaatgcaccgcttatgcgcaatgacgtagtagaaggtttgtcttggtttggtattgagttggacctagaaaaaaatgtattcggcaactatggtgacatttcaacggcagaatcaaaagttcgtgtcttggttatttcgacggatgaagaattggttattgcgcgtgaagtggaacgcttgaaataagaaaaactaactggtagtcggagactgccagtttctcttatagtttatacctttagaaaggtatagtttttagcaagtggacaaaatatatagtgtgtgatacaatagactagcaaagaaatttgcacagagtagatggtttgcgtcaagtgtatgtggatggggtgttgccacataacgaagctgatctttgcttgcatctgatgtctcctagagtaggaacattggtcctggctgagagtagcgcggtaaaccattgcatccgctgtcgaatacacacgacagctccattttttgaaaaaggagcattttttatggaaaagaaaattccaaaactaacggtgcagttgttggctgctattgcgatgacccttgccttggtcatgattgtagagaactatttctctattcggatttctgatactttacaggttcagtttaccttcattcccaatactattttgggagctattgcgggtccagtttgggcagctgtctttgcggctatttcagacccagtctttgtcttgtttagcgggcaaacggtcctcttcacttggattttgattgaggcggtatcggcatttatctacggctggttcttctatcgaaaaccgctagacaccaagaacaaggctgattggctctatgtggctggtgtagttgtcttgattcaggttgtgatttcctttatcatgacaccgattgccctccatttccattttggaacaccttggattgttctgtatagcagtcgcttgattaaggcagtttttgaaattccattacgcattgtcgtgaccatgcttgtcttgccaagtttacaaaaaatacctgaattggccaagttaatgggcattaaataaaacagtatcaagcaacaggtcatccccctgttgctacttttgtagagagggaatcatgaattatcaagaaactcgccggtggctatctagtcgtcctgcatcagatttagaaaatggcgttgcacgtgtcaactggattttagaacgcttggacaatccccagcttcaagtgccgaccgtacactttgtgggcacaaatggcaagggctcgaccctcaacgccttacagtctatcttgcagtcttcggattacaccgtcggccgctttacatcaccgtctatcattgattttcgagagcagattgtctaccagcaggagatgatttcggaggaagattttgcgaggattgtgacagacttgcaacccttgatcgaggacttggaccagacggctggactggatgccatctcggagtttgagattgtagtagtggctatgtttgtctactttgcccactaccagcgtcccgatattctcttggtggaggccggcatgggtggtttgcaggatgcgaccaatgtccttgcccccttggcagtagtttgtccgtccatcggtttggaccatcaggcatttttgggagagacccacgctgctatagcccgtcacaaggtcgccgtcttgcgtgagggggttccgctcatctatgcgaccgaccagccagaagtggagacagtatttgaggagcatgcctgtcagcttcagagtccgacctatgcggtggggcgggagattcttttggaaaatagcagagcaggctttgcagtttcaagtcctctcggccgtgtggaagagttaacactacagatgcagggtcgtcaccaggaggtcaatgcagccttggcagtgacaacagctcagctcattaaacctcattttccaacaattaccaatgaaaccatccgccagggcttgtcccaagccatctggccgggtcgcttagagttgattaggcctaatctcatgattgacggtgcccacaataatgaaagtatcgccgtcctgacacaactcttggaagaaaagtatgctgacagggatattgaaatcctctttgcggccatcaataccaagccagtggaccagatgttgtcccagcttagccaatttggacctgttagcgtgacgacctttgacgatttcagagcggtacagttagaagattatccgtcaggctatgaacgagttcagacctatcaggagtgggtggagcaggcggacttggacaatcccaaaaaactctacctgattacaggctcgctatatttcattacctatgtgaggaagtacattttagaagaacttgtatagaaaaaaaaggctttgccgggcattcaacccagcaaagtcttttgttttaataatttttaatcaaatcaaccgttgagcggtctagttttttaacgatggtctgcaagaaggcttgggcctctaagaagtcatccatgctgtagagagtttgatgtgaatggatgtagcgagcgcagacaccgatagttgttgatggaacaccatgatttttcaagtgggctgcaccagcatctgttccacctttaccacagtagtattggaatttgacacctgcttcttcggcagttgtgaggaggaagtctttcatgttttttaacatgatgtgacctggatcatagaaacgaagcagagttccgtcaccaatttttccttggtcgccgtaaatatctccagctggcgagcaatcaacagcgagaaaaatgtctggattgaacttggttgtagaggcatgagcaccacgaagaccaacctcttcttgcacattggccccagcaatcaactgatttggtaaagcatgaccggataggctttctagcaattccgtcaccataaggacaccgaagcggttgtcccaagccttagaaataacattttttccgttggctgttagaattgtttcatttttgggaacgaggacatcccccggacgaacgccgaacgcccaagcttcgtcataattggcaaaaccagcatcgaaaataatatcagcaatggcaggcatgccaggagcgttagcccctcgtgaaaggtgaggtggtactgagcctgagatggctggaatggtacgaccgtcctgcaactgaagagtgaaggcttggctagaaacaaccagaggattccagccacctagctcaacaacacggaaagtaccgtcaggcttgatttggctaatcataaagccaacttcatccatgtgggcgaccactaggatacgaggagcattttcaacagccgtatccttgataccaaaaattccacctagcccatctgtttcaatgcggtctacatgtggcgtgattttctggcggatgtggttgcgaacctgtccttcaaatcccggtaagctttgtaattcggtaacttctttaatttttccaaaaagagtcattcttcttcctccatgacatgattactactattttatcacgaagagctagacttgtcttgaaaatatagaaaaatatagaaaaatatagaaaaatatggatagtattgacaagaatgattgaagtttgctaggatagaaatgcccctcaaaatagagaggggagtgattgttaagtgtgggaagcatttatcgtcatttagtttttcttttattacttcgttaattcgccttgcctaacttcagttatgtctgcggctcattgcctcgtactaaaagtaaactaaaagactatatcacagtttttcttgtatctttgttcgtcagttttctaacagttttgtttgaaagatggctcaacaatcgtgacaatagagtgggatttatgacttagagtttgtgtcaacatctcagcgcagtggttgattggtagatttgttcgtgtttcacactccaaatctgaccattacctttgttgcgaacattgttcgctctatctccaacctccaaaggttccccgaacctttggagctatgcgtgggtgagactgaaacggtctgggaatagaccgttttagctcaacaactgaaaacaaggacttgttgacgaactcctttgttctgtctcgctccaaaagaaaaccctcaacgctggtaacgttggggcattttgattgccaagtgttgacaaacatttatcactgtaagaccattctatctatttttaagtcttttgtcaagtggtgcgagtttgtctcaactgtcacaagtccaatggcatttttgggaaaaatcctgggaaatatgataaaatagtcaacatgaaaaagaaaaagacagccttgctagcaggcttattgggggcaggtgtgctcaccgctagtgctcaattttaccgtaaaatccaagaagaccgtaaaaaagcacaggccttgcaggaggtgcgtgactttttcgctgatttaggagagattgccacggtctatgtggatgaaacggcttctacgcagaccactcttatcggaggggttgtgatggaggcaggacaggtatttttgtttgaaaataccaaaggttctattcaatacagggaggaagaaagatgatttttccaacaaatcatgaagaagtagctgccttgattgaagatggcaagccaactgtttttctatttgtgacgacttggtgtggagattgccactatattaaaccgcatgtgccagctatcgaagaagcttttccagatctccgttttgtgcaactggatcgagatgactttatgcctttggcacaggaatgggctattttaggcattccaagtctggttgttttggaaaatggtaaggaaatcggtcgttttgtcgataagaatcgcaagaccaaggaagaaatcatgaacttcttatctggactgggtagataaattagcagagaagctctgccatttcccaaaagaaaggaaagaacatgaagaaatcattaggaaaaatccttctagcacctgtggtgctggggttgagtttgagtcttgctcccttggtgcaggctgagattcaaacagatgttatcaatgaaaaatggggcaagccaacactagtctacggtggaggtttgtcagatgcgcaggcgacagaggttaacaatctatttggtatttcggatgtcaataatgtcagtcgtcaggtggttgttggtacggatatggaccaatatttaggtacatctgaagcggacacagcctccctctattcatctgtcttggtgcaaaagcaggacgctggcaaaggggttgtggtggatattaagacgccacagaacatcaccttgattaccgaaacgcagtatgccaatgcggctattacagctggtgcgacagatgtcttgattgatgtagcttctccgattcaggtaacgggggagtctgctttgacaggtgtttacaaggctctcgcagccaatggtgaaacagttgatacagcccgaactgaagtagcccaacaagagctagagacagtcaatgaagtggcgacggctcatacaggtgacactaattttgatagttcggccttggataaggcagtggcggaaatcaagactgctcttgccgactacaaaaagtccaatggtcaggtggcttctgaggctgacatcaacaccatcatcaatgatgttttggcccaaaacggtttggaaaatgtcatcacagcagatgaagtttcaaaattagttacctttgccaaagcttatcaggaaacctctgctattgattcggctgaggttgctgcccagctcaaccagttcaagcaacaggcggagcaacaaatttcagaagcctataagaatctacaagattcagggattttagaaaaaatcggtgccttctttgaaaatctttggaaaggcttgaccggtctatttgcataaaggagaaatgaaaaagaaatgatttttacatataataaggaacatgtcggcgatgttcttatggtgattgttgcggaggacaagggacaggctgtccagtttgaacgcaagggtcaagtggcgcgtgttttcctagaagaaacaggaaaaacagtggcctggaatatttttgaagcatcaagtttggttgaacttgatggaaatggtcaagttttcttgacagatgaacaagttgcgaccttgaatgctgaattggctaaggaaggttttactgaaagcttggttaacgacaatgctccaaagtttgtagtcggtcagattgtggaattggttcctcatccagacagcgaccacctcaatatctgtcaggtcaatgttggtgacaaaacagtgcaaatcgtagctggtgccccaaatgctgcccaaggattgaaaactattgtggctcttccgggggcaatgatgccgagcggtagcctgattttcccaggaaaattgcgcggtgaagatagctttggtatgatgtgtagtccgcgtgaattggcactgccaaacgcaccacaagtccgtggtattatcgaattagacgactccgcagtggtcggagaggcctttgatccagctaaacactggaaggggtagaaaaagaagaattggtcaggtggccaattcttttatgctggttcaatttttccttcaatagcctgttcgatttcttcggtcgaggcctgttgtgatttgagttggaaataaagactggacaggaaatgctggagattgagccaccggaagtagtctactggttcttgatttggaaagtccagcttgctaatccattccgtcagctcttggcttgacactttttcattcagcaggaggtagacagggatttgtgccagacggatttcctcgccagctgagaaaactttactttgtttagttagacaagtgacaatagtttgccagacttctttgcttttttcagcgggaaattgatcatgacagcttgtggccagaagaaaatctgctccgtgggcagcggtatggatccaaccgagtttttcatcgtagccagaccagtcattttcaatcgtcaaataatccaaggcctgctggaagagtagctcatggtcgtcagtgcttaaaaatgcatgataaatagactctggctcattatcgacagacagcaacagacagtaaagtaggcaagtaaaacttcgtttttgtgtggggccttctagggaaaatggcttggtttcttgagagaattgcagtagcgactgtgcttgttctcttgtaatcaagccctccaaaaagatatggcaaaaactagcatagaccagttcgtcgcgtatagtagggtctggatggccgatgttttccaacaaccaatccagttcggcattggtatatggttgggaggtctgtatcttttccatcaaaaattctttcatgattttcgctccttttctaatccttctacgaatagataagtaggaggatataatatgtataataaaacaattttaatcggtcgcttgacggcccaacctgaactcactcaaacaccaactggcaaaaatttgactcgtgtaactgtcgcagtcaatcgccgatttaagacagaaaatggtgagcgtgaagcagattttctcaatgttattttctggggcaaactggcggagacacttgtttcttatggcagcaagggtagtctgatttctattgatggtgagttgcgaacgcgaaaatacgaaaaagacggcagcaaccactatgtgacagagattctaggccaatctttccaattactagaaagccgtgctcaacgtgccatgcgtgaaaataatactggtgatgacctagctgacttggtcttggaagaggaggaattaccgttttaaagcaatatcagtcccaagaccgatggagtgtattgaaaaataggctatactatagtcaatcctaaatatttttcatatctccttaaaaacaccgacgaaagttggtgtttttggctacttattttctatatttccaccattctatcagcatgataattagagaaagtaggagaactccgtagaagaaaaagatgatgtaatgagggtgggaaaagagaagccaccagactagccagagtaggtaggcgaatatcattttccccaaaaagcctaatttacgttttaaaaaccattctgcaaaactttcgtaggctgaaaatcggctttcaaggtaatcaatttttaaatctctaaaaaatttcatgaataccccctaactttttaaaaatagtatagcataatttagcggtaatggataggcaagttctgtctcggtctcaagatggattttcatgaaaaagggatagaatgttcttgactatttttgaccaagtgatacaataggaaatgtgaattagcactcgaatacaaagagtgctaaaaagaccaggaggtaataccatgttgaaaccattgggcgatcgtatcgccgtaaaaattgaagaaaaagaacaaacagttggtggctttgtcctagcaggcgcaagccaagaaaagacaaaagaagcaagtgtcctagcgatcggacaagggattcggaccttgaacggagacttggttgccccagcggtggcagttggagatactgttttgattgatgctcacgcaggattggaagtcaaagacggtgatcagaacgttcacatcatccgtgaaacagatattttggcaattgtagaatagaggtagaaaaatggcaaaagaaatcaaatttgcagcagatgcgcgtgaaagcatggtccgtggtgtcgatattttggctgacacagtcaaagtaaccttgggtccaaaaggtcgtaatgttgtcttggaaaaagcttacggttcaccactcattacaaacgacggtgtaaccattgctaaagaaatcgagttggaagatcattttgaaaatatgggtgctaagttggtatccgaagtggcttcaaaaaccaatgacattgccggtgacgggacaacaactgctactgtcttgacccaagctatcgtacgtgaaggcttgaaaaacgtaactgcaggtgccaacccaatcggaattcgtcgcgggattgaagccgcggttgcgactgcggttgaagccttgaaagcacaagcaagtcctgtatccaataaagctgaaattgctcaggtagcagccgtgtcttcacgttctgaaaaagttggtgagtacatttcagaagctatggagcgcgtgggaacagacggcgttattactatcgaagaatctcgcggtatggaaacagaattggatgtggttgaaggtatgcaattcgaccgtggttatctgtcacaatacatggtaacagataatgaaaagatggtagctgaacttgaaaatccatttatcttgattacagataagaagatttctcatatccaagatattttgccactcttggaaagcattcttcaggccaaccgtccgcttttgattattgctgacgatgtggatggcgaagctcttcctacacttgttctcaacaagattcgtggtacattcaacgttgttgcagtcaaagctccaggctttggtgaccgtcgtaaagccatgttggaagatatcgctatcttgacaggtggtacagtcattacagaagaccttggtttggacttgaaagatgcgaccattgaagcccttggtcaagctgccaaggttgtggtcgacaaagatggtgcaaccattgttgaaggtgctggcaatcctgaagccattgccaaccgtgtggctgttatcaagtcacaaattgaggtaaccacttcagaatttgaccgtgaaaaattgcaagagcgcttggctaaattgtcaggtggtgtcgcagttatcaaagtcggtgccgcgacggaaactgagttgaaagaaatgaaactccgtatcgaagatgccctcaacgcaacacgtgccgcagttgaagaaggaatcgttgccggtggtggtacagcacttgtaaatgttatcgatagcgtagcgaaattggagttgaaaggcgacgatgaaacaggacgcaatattgtccttcgtgccttggaagaaccagttcgtcagattgcctataacgcaggctatgaaggttcagttatcattgataaattgaagaattctgagcttggcactggctttaacgctgcgacaggcgaatgggtcaatatgatggatgcaggtattattgaccctgttaaggtgactcgttcggcccttcaaaacgcagcttctgtagccagcttgattttgacgacagaagcagttgttgccaacaagccagaaccagctgctccagctatgccacaaggtatggatggaatgggtatgggctactaagaaatagcaaaatgacacagctacttggctgtgtttttttcttgaaaatttcaaacatatctatttgacaatggttttgggatgtggtactatattagacggtactttttacttttggtctctcaagagtgtacagggacgtgctgacaaatgttgcaaaagtacacacagataggggttgtcaccaatgccctatcaccaaaaataaaaaatatatacaggagaatgtagatgcctacaattaaccagttggtacgtaaaccacgtaagtctaaagtagaaaaatctaaatcaccagctttgaacgttggttacaacagccgtaaaaaagttcaaacaaacgtttcatcaccacaaaaacgcggtgttgcaactcgtgtcggaacaatgacacctaaaaaacctaactcagcccttcgtaaatttgctcgtgtacgtttgagcaaccttatcgaagttactgcttacatcccaggtatcggtcacaacttgcaagaacacagtgtggttcttcttcgtggtggacgtgtaaaagaccttccaggggtacgttaccatatcgttcgtggtgcacttgatactgctggtgtaaacgatcgtaagcaaggccgttctaaatacggtactaaacgtccaaaaggctaagaagggggaaatataaatgagtcgtaaaaatcaagcgcctaagcgcgaagtattgccagatccattgtataactcaaaattggtaactcgcttgattaaccgtgttatgttggacggtaaacgtggtactgctgcatcaatcgtttacggtgcctttgatcaaatcaaagaagcaactggtaacgatgcacttgaagtatttgaaacagcaatggaaaacatcatgcctgtacttgaagtacgtgcacgtcgtgtcggtggttctaactaccaagtcccagttgaagttcgtccagagcgtcgtacaacacttggtcttcgttggttggtaacaatcgctcgtaaccgtggtgagcacactatgatcgatcgccttgcgaaagaaatcatggatgcagcaaacaacacaggtgcagctgttaagaaacgtgaagatactcacaaaatggcagaagcaaaccgcgcattcgcacacttccgctggtaagataggatattttagcgttaaacaaatgctagccaaaataggaaaattgacgcagaaacttcagtttctaggagattttatctttttggcagacatttgtagctaaaattcaactaagattaagatacgagggcgtcaagcaactcctagacaaaatagggaagcgaagcagattgctgtgcaatcaatgaggttcatctttttgtcagcgagttgtagcccgagttcaattaggatgtaaggacgttaagaaaattcaaggaaaaataggaaatcagacgatggaccttaaggtccaaggaagatttatcttttttccagaatttttagttcgaactcaactaattaagatgtgaggacgttaaatcagttctacataaatcaattgagattatggtagcaacttatcgttcaaccatcacaaatcggattgaggcttgcctcgtccacttcacaccattagtaagaacttaagcgggtgggatttgcccactcgcttttcttaaaatatggtataatcagaatagaaatctaaaaatataggagaacaaacctcatggcacgcgaattttcattagaaaaaactcgtaatatcggtatcatggcgcacgttgacgcgggtaaaacaacgacaactgagcgtattctttactacactggtaaaatccacaaaatcggtgaaactcacgaaggtgcatcgcaaatggactggatggagcaagagcaagagcgtggtatcactatcacatctgctgcgacaacagctcaatggaacaaccaccgtgtaaacatcatcgacacaccaggacacgtggacttcacaatcgaagtgcaacgttcacttcgcgttcttgatggtgcggtaaccgttcttgactcacagtcaggtgttgagccacaaactgaaacagtatggcgtcaagcaactgaatacggtgttccacgtatcgtattcgctaacaaaatggataaaatcggtgctgacttcctttactcagtaagcacactccatgagcgtcttcaagcaaatgctcatccaatccaattgccaatcggttctgaagatgagttccgtggtatcatcgacttgatcaagatgaaagctgaaatctatactaacgaccttggtacagatattcttgaagaagatattccagctgaataccttgagcaagctgaagaataccgtgaaaaattggttgaagcagttgctgaaactgatgaagaattgatgatgaaataccttgaaggtgaagaaatcacaaatgacgaattgaaagctgctatccgtaaagcaactatcaacgttgaattcttcccagtattgtgtggttcagccttcaaaaacaaaggtgttcagttgatgcttgatgcggttatcgactaccttccaagcccacttgacatccctgctattaaaggtgttaacccagatacagatgctgaagaagagcgtcatgcatcagatgaggagccatttgcagctcttgccttcaagatcatgactgacccattcgtaggtcgtttgacattcttccgtgtatactcaggtgtccttaacagcggttcatacgtattgaacacttctaaaggtaaacgtgagcgtattggacgtatccttcaaatgcacgcaaacagccgtcaagaaattgaaactgtttatgcaggtgacatcgccgctgcggttggtttgaaagatactacaactggtgactcattgacagatgaaaaagcaaaaatcatccttgagtcaatccacgttccagaaccagttatccaattgatggttgagcctaaatctaaagctgaccaagacaagatgggtattgccctttctaaattggctgaagaagatccaacattccgcgttgaaacaaacgttgaaactggtgaaacagttatctctggtatgggtgagttgcacttggatgtccttgttgaccgtatgcgtcgtgaattcaaggttgaagcaaacgtaggtgctcctcaagtatcataccgtgaaacattccgcgcttctacacaagctcgtggtttcttcaaacgccagtctggtggtaaaggtcaattcggtgacgtttggatcgaattcacaccaaacgaagaaggtaaaggtttcgagttcgagaacgctatcgtcggtggtgtggttccacgtgaattcatcccagcggttgaaaaaggtctcgtagaatctatggctaacggtgttcttgctggttacccaattgttgacgttaaagctaagctttacgatggttcataccacgatgtcgactcatctgaaacagccttcaaagtggctgcatctcttgcccttaaagaagcggctaaatcagctcaaccaactatccttgagccaatgatgcttgtaacaatcactgcacctgaagataacctaggtgacgttatgggtcacgttactgcacgtcgtggtcgcgttgatggtatggaagctcgtggtaacacacagattgttcgtgcttatgtaccacttgctgaaatgtttggttacgcaactgttcttcgttcagcaacacaaggtcgcggtactttcatgatggtatttgaccactacgaagatgtaccaaaatctgtacaagatgaaatcattaagaaaaacggtggcaatgcataattgtctatctacacctaccttcgggtaggtgtttttttggtacgacggatatgtcacacatctgagcgtgatactcatactcttcgaaaatcaaaattatccgttgtcaacttgccttgatgaactccagttctatcttcggcttcgtttcctaggctacttttgattttcattgagtatcagtagtttatctttgattgcttcgacgagcgaggaaacttcgtttccttatttccaacttcaaacacttcactggagtatttgaactcgctttgtcgtactttacagaagtgatttgcgaggcaagtcttatttccaacctagaacagcctttaggctgttctagcaacttgcagctattgagacgaacttgcttcgccctatctccagccttcaaaggtttcccgaacctttgaagcgagtactaaaaacaaactaaacgactacactatataaaacagatatccgccagattcattttggaaatatacaatgagaaagctacaatttataaaaaattaccctaatttaggtgtggatggctaacaaaagatcagggtttgctattttgggatttcattgggtataagttcctgttgtcgatgaactcaacagtgactcccaggtccgactactgtgaaataaacggattaaaacagtctggggttagactatttcagctcaacaactagaaattaggaattgttgccgaactcttttgatcgttcgagttctcgcctactcacacttaatcagctaaaataaatgttttaaattatttagaattactttgtttgggaatggttataaaaaataagagaattaatagataggctacagaagaaaagcagatataaatgttagaatccttataaggtagatcgatgaaagagtagtttaggaccgctaattactaaaggaggatgcttgtatggtgatgaaatagtggtactaagcacattaacaataaaaagaaaggacagaaaccatgagaaaaaaactaaaattttcattagtagcagtcgcctgtgcgacatttttgacagcctgtggcacaagtaattcctcggctcccaaagcaggtgaagcaacaccacagacggattttcattcttatatcaatgcgcaatggttgaaaaatacaaaattaggtgccggtgaatcgcaaatagataatctgagtcaactctctgagaaaacgcaagaagcgatacaggagatgattgaccagctggatatggactattccaagctgcaagctggtagtgatgagaaaaaacttattgatttttaccgattggcagccgattttgatactcgcaacaaattggggttagagcctattaagccttatctagaggagattaaaaaagcctctaccatggaagaactcaacaagattctggtggccctatacggcaaaaacatccgcaatttgcttcatataaacgttactcaagatataaaagacagtaacaaaaacaccatctacgttgaccctcacgagttaagttttccaaaagaaaattatgatggcacagatgaattttcattgaaaaatcaaaaagcctttaaagcctatctgcaggaagtatttagcttgtcaggagaaacctcaaaagaagcctcttctaaggcagatctcctctttaatttggaaaaagagatggctgcagtgcaacggccaaaagaagaagccaataactttgaagccatgtataacgagaagacttgggatgaggtcaaagcactggttcccaacctaccgattgctgagttggtttctgagttaggacttcagaatgccccaacgacagtcgtatcagatccagatgctctaaaaaatttaaatgaactctatcaagaaaagaatttagacgctcttaaggctctgctccaatatcgtgtgattgcccattacaatgcttatctgtcaagcaatttaatcgaggcaaaagcgaaatacgacggcgtagcaaccggtgcggtagatactccgagtcagaaagaagttgctcaagcggccattgatgcaaatttctccgatatgattggcaaagtttacgttaaacaccatttttcagaagaatccaaggctaatatcctatctatggttcaagagattaaagcgacttatgcagagcgaatcaaagcagtgcagtggatgtctgaagaaaccaagatgcgggccttgaaaaaactagatacattggttgttaaaatcggctatccagaccagtggaaggattactcacaacttgctatccaatccaaggaagaaggggggagtcttctttctaacttcgatatggtaaaaacacttgaattgcgtgaagagatggggcaatttggcaagccttttgataagtcgcagttcggcatgccttctcacacggtgaatgcctattacagcccaactaacaacgaaattgtctttccagcggggattttacaggctcctctctacgatccaaaagctagtcccgaagaaaatctaggtggaatcggggctgttatcggtcatgaaatttcccatgcctttgataaggctggttctcaatttgatgaaaaggggaaccttgtcaactggtggaaaccagaagaccttgaaaaatttaataaaaaggttcaacaggcagcagatatctactctaaattggaagtggctccgggctactatgtcaatggcgaaatttcaaccggtgaaatcatggcggatctcggtggtttaacggttgccattgatattgctcagaaaaaaggctacgatacgaagaaagtcttcgagtcttatggtaaagcatggcgtgaagtcaccaccaaagaatttgctattgccaacatcagcgacgaacatccaccagctaaatatcgggttaacaacattgtcaaccaaattgatcaattctatacagacttcaatgtcaaagaaggggatccaatgtatgtgaaaccagaagaccgcctacgagtgtggtaaaagattatagaggtgtctgcggtccaaaatgggcggtagacacctttttaggtaaaaaatagaagtagcggtaaaccaagaatcggtaaaaaatgtgtcgaggtatggcaatgctattaagttaagtatttaaccagtcataaccacccgagaaaacgcatggctatgatttttaacttttattttttggccttctattttttacataagatgaaccggtaagcagttgcaattttcggtaaatagttatataataaaaacgttgaaaagatgcttgtaggcttacaagttaatattttcacaaaaggattaaaaggcttgccttttaaaataaagaactcgattttcataaggaggaaatcattcatggtagttaaagttggtattaacggtttcggacgtatcggtcgtcttgctttccgtcgtatccaaaacgtagaaggtgttgaagttactcgtatcaacgaccttacagatccagtaatgcttgcacacttgttgaaatatgacacaactcaaggtcgtttcgacggtactgttgaagttaaagacggtggtttcgaagttaacggtaaattcgttaaagtttctgcagagcgcgagccaggaaacatcgactgggctactgatggcgtagatatcgttttggaagctacaggtttctttgcttctaaagaaaaagctgagcaacacatccacgctaacggtgctaaaaaagttgttgtcactgctcctggtggtaacgatgttaagactgttgttttcaacactaaccacgacatccttgatggtactgaaacagttatctcaggtgcttcatgtactacaaactgtttggcaccaatggctaaagctcttcacgatgcatttggcgttcaaaaaggtttgatgactacaatccacggttacactggtgaccaaatggttcttgacggaccacaccgtggtggtgaccttcgtcgtgcacgtgctgctgctgcaaacatcgttcctaactcaactggtgctgctaaagctatcggcttggtaatcccagaattgaacggtaaacttgacggtgctgcacaacgtgttccagttccaacaggttctgtaactgaattggttgcaactcttgacaagaaagtaactgctgaagaagtaaacgctgctatgaaagctgctgctactgaatcatttggttacactgaagaccaactcgtatcttcagatatcgtaggtatctcattcggttcattgtttgatgcaactcaaactaaagttatcgaagttgatggcgagcaattggttaaagttgtttcatggtacgacaacgaaatgtcttacactgcacaacttgttcgtactcttgagtacttcgcaaaaatcgctaaataatccttagtgaaaatcgaagaggcttcggcctcttttttgttttgattgctgaaatatagctgtttccttatgctaagaaacaaggatggtataagttgtttctgatttggcaactttagaatttgaaaaatctgattacgaggcgatagtttttagatttcataacatttgtgaaaaaaatatctttatgcaagaaaaaatacagaaaatatgatacaatggtaaagtaaatataatttaaggagttcttatctaatggcaaaattgactgttaaagatgtagaattgaaaggcaaaaaagttcttgttcgtgtggacttcaacgtgcctttgaaagatggcgttatcactaacgataaccgtattacagcagctcttccaactatcaagtatattcttgagcaaggtggacgtgcaattcttttctctcaccttggtcgtgtgaaagaagaagctgacaaagaaggtaaatcattggctcctgtagcagctgacttggcggctaaattgggtcaagacgttgctttcatcgcaggtgctactcgtggtgctgaattggaagcagctatcaatgctttggaagatggacaagttctccttgttgaaaacactcgtttcgaagatgttgatggtaagaaagaatctaaaaacgacgaagaacttggtaaatactgggcttcacttggtgatggtatcttcgttaacgatgcatttggtactgcacaccgttcacacgcatcaaacgttggtatctcagcaaacgtagaaaaagcagtagctggtttccttttggaaaacgaaattgcttacatccaagaagctgttgaaactccagagcgcccattcgtggcaatccttggcggttcaaaagtatctgataagatcggtgttatcgagaaccttcttgaaaaagctgacaaagttcttatcggtggtggtatgacttacacattctacaaagctcaaggtatcgaaatcggtaactcacttgtagaagaagacaagcttgatgtggcaaaaacacttcttgaaaaagcaaatggtaaattaatcttgccagttgactcaaaagaagcaaacgcatttgctggatacactgaagttcgcgatacagacggcgaagcagtttcagaaggcttccttggtcttgacatcggtcctaagtcaatcgctaagtttgacgaagctttgactggtgcgaaaacagttgtttggaacggacctatgggtgtatttgaaaacccagacttccaagctggtacaatcggtgtaatggacgctatcgtgaaacaaccaggcgtgaaatcaattatcggtggtggtgactcagcggcagctgcgatcaaccttggccgtgcagacaagttctcatggatctcaactggtggtggtgcatcaatggaactcctcgaaggtaaagtgcttccaggacttgcagctttgactgaaaaataggcggtaagtcaggaatctatgattccgtagacgcacccccgcaaggctgaataggttggtcacaagcgtagcaaagtgaactgccattcagctactgcgtatgaaagatgaacgatgaaaagagttgggagaccaactcttttctagtacaaaggctagattttctgtgaacgtagtgagtttagaaaatcagcctaggtaaaggctaaaatgcaacggatttccgttgcattttgtgcatcgcgtagagtttctacgaagctaagcgagttagaaagtctagcaaggtgtaaagtgcttccaggacttgcgacggcacggagtgcctagtgccatgcctagtctttctgggaagtgtgacctagaaagactggctaggtgctgccttgactgagaaataggcggtgagtcagttcaacatatctcccagatatgttgaggttagaaatagaagaaacgaagcttctgtcaaaaatgattccgtagattgttactttgatttttcttggtgacaacttcaaatagtccactgggctatttgaaccccgcaaggctgaatcttggtcacaactcccattcagctactgcgctaaaaatataaatgtaaaaaaagacgttgttttttgcagcgtctatttgtttgtcttacttctgggttccttcttgcagctgatttaaagtggcagattattggtttttcgaaaagctggcgtgaacaggaggcttttccagtcgagcttaggagaaaagaaaagctgggcaggtatttgctattctattttccgaaatcatgttagaatagaggcatgtttaaaaaatatacatttgatccaaagaaatttcggttggggatgcggacgttcaaatcgggtttggcagttttcctagttattcttttgtttggttttatgggctggcaagggattcagattgcggctttgacggctgtgtttagtttacgagaagacttcgatcagagtgtccattttggagcttctcggattctgggcaattctattggtggtttttatgcgctacttttctttattttggataggttattcttagatcatttttgggtaactgcggtttttgttccgatatttgtcatgttaacgattatgacaaatgtggcgatgaataataaagcgggaattattggtggagtatcagctttattaattattacattgtctattcctgctggtgatacgattcaatatgtgtttattcgtgtgtttgaaacctttatcggagttttcattgcgattctagttaattatgatgtgaatgttataaaaaaacgttttcaggataaatgatgttataaaatataacatcacctattgacctcaaaaaaaaattctcctataatggtaggcagaaaggagttcattatgagagaaaaagagtttcgtcgttccttagctatctttccgatcggtagtgtgatgaagttgacagatttaactgctcgtcaaattcgttactatgaagatcaaggcttgattaagcccgatcgcaacgaagggaatcgtcgcttgtattctctaaacgatatggacttacttttagaaatcaaggattttttggatgaaggtttgaatattgctgcgattaagaaggaatatgcaaatcgggaagcgaaagctaaggtccaaaaacagcagaaaaccttgactgatgaagatgtccgtcgtatcttacatgatgaattcagtcgtcagggacgattttcaagtcctagttccattttccgttcgtcgtaattagcttttaaaatagaggagaaaaataatgacattcacagtggcagatatcaagcgcgatatcaaagagaaaaacgttaccttcctacgtcttatgtttacagacatcatgggagtgatgaaaaacgtagaaattccagcaactgatgagcaggtcgaaaaggttttgtcaaataaggtcatgtttgatggttcatctattgaaggatttgttcgtatcaatgaatcagatatgtatctttacccagatttggatacatggactatcttcccttggggtgatgaaaatggccgtgtagctggcttgatttgtgatatttatacaacagatgctaagccttttgctggtgacccacgtggaaatttgaagaaatcgcttcgtcacatggaagaggcaggtttctcttcattcaaccttggtccagaaccagaattcttcctctttaagatggacgaacaaggaaatccaacgcttgaagtaaatgataaaggtggttactttgacctcgcaccaacggacttggctgataatacacgtcgcgaaatcgtcaatgtcttgacagagatgggctttgaagttgaagcgagtcatcacgaagtggcagtaggtcagcatgaaattgacttcaaatatgcggatgtcttaaaagcttgtgacaatattcaaatcttcaagttagttgttaaaacaattgctcgtaagcatggcatgtatgcgacctttatggccaagcctaagtttggtattgctggctcaggtatgcactgtaacatgtccctctttgacaaggatggaaacaatgccttctttgatccagaagatcctcgcggtatgcaactgtctcaaactgcttaccatttccttggtggtttgattaagcatgcttataactatactgctattacaaacccgacagtgaactcttacaagcgtttggttccaggctttgaagctcctgtgtatattgcttgggctggtaaaaaccgctcaccattggttcgcgtacctgcatcacgtggaatgggaactcgtttggaattgcgctcggttgatccaactgccaacccatacttagctatggcagttctattggaagttggcttggaaggtattcaaaataaaattgaagcaccagcaccagtagaatctaatatctatgcaatgtctgatgaggagcgtcgtgaagcaggtatcactgatcttccttcaactcttcacaatgcattgaaagctcttcgtgaagacgaggtagttcgtgcagctctaggtgatcatatctatacgaatttcttggaagctaagaaaatcgaatgggcaagctacgcaacctacgtttctcaatgggaaatcgacaactatttggatatgtattaaacaaaggaccccgacgggtcctttgttcacgagccgagaaattggaaatcgggtaatggtccagtggagtgaagtggtctggaaagagactgtttcagtctgagctaataaatagcagggcgaggggatagacatgagcttgaaatctgtcttttttcaagctgggttatcttgttaatataaaataaatcccagaggtttcacctctgggattttagtgtgttatcggtcaggcgtcagaatcattgggataatgattggttcacgctctgttttttcgtataggaatggtcgtagggcgttaacaatggcgccgttgactgtttggatatttgcgtctttgttgcgcatggcgatgcggatagcgttgaaaaggacgcgttggctttcgcgaatgagctcgccagattctctcatatagataaagccacggctgaggatgtctggtcctgctaatatcatcttagaattaaaatcgacagtggctactgcaaggacaacaccatcttctgaaagatcgcggcggtcttttagaacagctgcgccgatttcaccgatgcggtttccatcaacatagatgtcttgggcgttgaattgacctgcgagacgtgcagaatcttttgtcagagcaaggacatctccgttttccatgatgaagatattatctttgggaacgcctgtatcaacagctaggctggcatggattttttgcatgcggtattcaccatggacaggcatgaagtatttgggtttgatcaagcggagcatgagtttttgctcttgttgaccaccgtgtccagaggtatggatgttgttgatcttgccgtgaataacatcgacaccggcttcaatcaagatattgatgagcttgttgacacctgtggtatttcccggaataggactggacgagaagataaccgtgtcgcctggctggagttgcacctgacggtgggtaccgtgggcgatgcgagagagtgcggccataggctcaccctggctacctgtacagagaatcatgatctcgctggcagggtattctttgatctcgtttggctcgatgaaggtatccttaggcaccttgatgtagccgagctcgataccgttaacaatggctttttccatggaacgtccaaagacagcgatcttgcgtccggtcttaaccgctgcatcagccgcctgttggagacggaagatgttggaggcaaaggaagcaaagatgatgcgtccgtgaatgccttcaatcagcttcataatggactgaccgaccactttttccgagttggtgaaggttgggacttcagcatttgtcgagtcggaaaggaggcagagaacgccttcttcacccagggcggccatgcggtgaaggtctgctggctcaccaacaggagtgaagtcgaacttgaagtcaccggtacagacgattttcccttgaggtgtatcaacgacgataccgagaggttctggaatggagtgggtggtacggaagaagctgactttgaggtgcttgaaggtcaactctgtattatgattgatttcatgcaaagtcgcatcacggagcagaccgtgttcttccaatttgcctcgaataagggcgagggctaaaggtccagcatagattgggacattggcctgcttgagtaagaagggaatgcctccgatgtggtcttcgtgcccgtgggtaataaccagacctttaacgcggtctaggttttcaacgatgtaggagtagtctgggataacgtagtcgatacccaataggtcatcttctgggaacttgataccggcatcgacgatgagaatttcatccttatactcgataccgtaggtgtttttcccgatttctcccaaaccaccgatggcgaaaacgccaacttcatgaggttttagattgactgatgacatggattaaaactccgtaattttgaaatctgcgtgctctttctcgtattcaagatgattgtctgataagaggtcgataaattcgatattgtattcagggcggttggtttccaccaattcacgcgcgataatacgaccttccaattctgatgcagcatcgatgtctagataaagagcacgtgtctgctcgcgacgtgggctaatttttgattcttgatagaatactttataaatcatgtgtagtatagttcctttctttttgactggcaactatgaaaaaagcctcaaacagttgggtctgtctggtaatatctattcaattttctcgagttgtcaatttattcagtctaaatgtactcttcattataccataaaatatgctgatggtaaaagggtttggtaggaaaatggaaaagtgtcatgattttcagaaattcggtatttcagaagggtataaatcaaagaaatgagttaggattccgagtgtgttgggattactaagactaagttcaattgtgctgagaaatgcctatcaactgccagatagtgatgtgacttactagaatgacaaatcggttcgatccattaacctactagaaatcacaccccagtcttttccattatttgaaaaaatatccaagatagcttacaatagagagtagcatttaaaagtctttcagtttgcttttagtactaggcaacgagctgcgggctgtactggagtacggcacagggagttcaaacaatacagtgtattgtttgaagtgggaaatacggaaacgaagtttcctcaagtgttgaagtaataaaagcaaaccgaatgacgtaaagaaagagaaacttatgaaaatactagctttggacagctccaatcaggccttatcggttgccttggtggaggacggtcgtttgcaggcggaaaccctgttggctgtcaagaaaaatcatagtatcagcctcatgcctgtggttgattttttggtagcgcaggtgggctggacacccaaagacctggatcggattgtggtcgctcagggacctggctcctacacgggcctgcgggtggcggtggcgaccgccaagaccttggcctacaccctcaagatcgacttggtggggctatctagtcttcagtctctggttcctcctagcctgacgggtctggtggtgcctctcattgatgcccgccgtaactgcgtctatgcaggtgtttatgaaaatggcagagcagtcgagccagaccgctactggtcttttgaagacttgctttctagcctgtctggtaaggaaaatattacctttgtcggagaagtagaaaactttatggagcaaatcgaacaagctctaccgactgctcagtatcaagctagtctgccgtctgcctatcagctagcagtaatcggtcaagacttgccagcagtagatgtgacgagctttgagcccaactatctcaagcatgtagaggcagaagaaaactggctcaaggacaaccaagttggctcagaaagttatatcaagcgtgtatgatagagattaaacactacgacggtcaggaaaatctggcggaggctgtgttggcagttatgcagtccgtctatgatcagtcaccttggaccttggaacagattgtttcaagcatgaccagtcagtatgaggattattatttggcctatgagggtcaggaattggtcggatttttggctgtgcagacggtgctggatgagatggaaatcttgcagattgctgtcaagactgattttcagaggctgggaatcgccagtcaactgatggctgctgtgatggactgggatggggatattttcctcgaagtgagagagtccaatagcgcagctcaggccctctatacacgccagcattttaccaaaataggaaaacgaaaagactactaccgccatcctgtcgaggacgcggtgataatgaagagagaacgtgatgaaagatagattgattttggcgatcgagacctcctgtgacgagacctcggtggctgttttgcgaaatgacgcggagcttttatccaacgtcattgccagccagattgccagccaccagcggtttggtggggtggtgcccgaggtggccagccgtcaccatgtggaagtgataacggcctgtatcgaggaggccttgttggaggcggaagtgacggcagaggacctgacggctgtggctgtgacctatgggcctggcttagttggtgccctgttggtcgggatttcagctgctaaggcctttgcctgggctaacggtctgccgctcattcctgtcaaccacatggcagggcatttgatggcggcgcgggcggtcaaggagttggagtttccgctcttggctcttttggtcagcggtgggcacacggagttggtctatgtgtcagaggcaggtgactacaagattgtcggtgaaacgcgagatgatgcggtcggcgaagcctatgataaggtgggtcgggtcatgggcctgccctatccagctggtcgggtgattgacgaattggcacatgaggggcaagacatttatgacttccctcgggctatgattaaagaggataatttggagttttctttctctggtttgaaatccgcctttatcaacctctaccacaatgcccagcagaaaggggagaccttgtccaatgcggacttgtcagcctctttccaagcctgtgttatggacattctcatggctaagaccaagaaggccttggagcaataccctgtcaaaaccttggtggtagcgggcggtgtggcagctaatcagggcttgcgagagcggttggctgctgaaattaccgatgtggaggttatcattcccccgcttcgcctctgcggtgacaatgcaggtatgattgccttagcagcggtcagtgagtacaataaggaaaaccttgctggctgggacctcaatgccaagcctagtctggcttttgagaatttatagaataaaaacctcttacgtcaaggatacgtaagaggtttatttgtggatttttcgccagcgatttggagaaatttggtaatgtcttttaaaagcagttgaaaaattgaattggttggagtagccgatttcttcagcaatttcctgtagtgtcttagtagtgttttttaagagttcgcaggcttcgctgagtcggtattggatgataaattgttgaggtgagatgttcatttgctccttgaatagccgactgaagtagtggcgattgaggttgcacacttgtgccaaatcatcgacggatatagctttctcataatttcgttctacgaagttgatagcttctcgtatataaaattccttgttttcatcgtgtttgctacttgttttggttagcgaacagtcaatgaggcaggagataaagaggtaaaggtgtccgagaactagagcgcttttttgatgatggagcgcgagaatttgtttcatttcatggtagacagggctagaggtgggcatttctcgttgtgaaaagataggttgttctttcgagagccctgcctgtctgagaaaatgctcagttttcagaccgtcaaattcaagccagatataggtccaggggtccttttcgtctgcttcgtagctacagatggcgtctggggagataaggaagccctgtcctgcggttaggtggtattcacgttggtcggaggtatcgtaaaaagtacctgaaccagagatgatgtagtgaaacaggtagtgttgtttcatagttgggccgaatgagtgaagtggcttacaggcttccatgccaaattggatggggtaaaaatctacataggatctgttattaaagacgtaaaattcaggttgtattttcatcgtattctccataccaaaagtgtaaaggcttacaattagtatagcatatttatatgtaaatgtgacattttatttgaaaaaattaaaaaatatcccaaaatcatatggaatatgtcaaatattcctatttgattataaagcgcttacatgttatagttatagtagaaataacaaagttcgtcgacgtattcgacaaaagaaaaggagtattatcatgaagaaaattggtcgctatgttaccttgcttgcggctgcaggcctgctggcagcgtgttctacttcgactgagtctagcaaaactacgggaggaagtagttcaggaaagacagaaatatcctatgctatttgggattctggtcaagagcctggtttgagaaagattgcggatgagtttgagaaaaagaatccagatattaaaatcaatattcaagtatcggactgggattcctactggaccatgttagaagctggtgcgacaggtggttcattgcctgataccttctggatgcattcaaatgagatttatcgctatggttccaatgaaatgctattgccattggatgaatacttagccaagagtgaagatgccaaactagctaatttcccagatggtttgaatgaaatctacaacataaatggtaagcagtacgctattccaaaagatttcgatacaatcggtctttggtacaataaaaaattatttgacgaagcaggcattccatatccagatgatacttgggattggaataagttgaaagaagtagcgaagaaattgaccaagccagatggtagtcagtatggtttcggtgctggtttgagtaaccaagagggctactacaactttatctatcaaaatggtggtaaggttattactgatgatttgaaatcaggctatgctgatcctaagaccattgaggctttggattactactttagctttgtcaaagaaaaaatttcaccggctattacagtagataaagagcgggccgaagcattccaaaacggtcaagtggctatgagcgtcttcggttcttggaatttatctggtttcactgctaatgactacattcgtgaaaatgctgatgtagctgttttgccaaaaggtccagatggaactcgtgcaaccatctttaatggattgggtcatgccattgctgctaccactaaacatccagatgctgcttggaaatgggttgaatacctcagctcaaaagaggcacaagaaatgcaggcaacacttggtgtggcaatctcggcttataaaggcgcggcagatacttgggtagattcaaacaaaaactttactatcaagaattatgttgacatggtggattatgcacagattcgtccatattcacaaacaaccatcaagtgggaagataaggcttatgagctattgaaacctgcttatcttggagaaaaagcaactgaagaagctgccaaagaaacagctgatatgatgaatgctgaattagcaactgaaaaataggtaggaggtcttgggaagttgattcttccccggaccttcttattaaaatgaagaaggatggggataagatgttccgaaaaaaaggaagtttaaatgaggcaatttggggatggggaatggtagcaccgaccattattggattaatcgtgctcaatattattcctattttccaaaccatgaagatgagttttcataagagtggagatttcggcaaaggtgacatctttgtcggcttggcaaattaccaacgcatgttaggggatgcgcaagtgtggcaggcgacatggaataccttgaaatatacgattctagttgttccggctaccgttgccttggccatgttgcttgcagttttgcttaattctaagattaaaggtaagcatatttatcgaaccatttttttcttgcctatggtggcagcaccagccgcggtgaccatggtttggaaatggctctacaatacggacttcggcttgattaactatatcttgcgtcgtttgggactgggtgctgtgaactggattgaagatccaaagattgctctatactcaatcgctttgattggaatttggagtacggttggctatagtatgattttaattttagctggtttgcaagaaattccaacggatttttatgaggcagctcgcattgatggagctagtccggccaagcaatttttctccattaccctgccattggtttcaccaaccctgttctttgttgtggtaaccagtgtcattcaatccatgcaagtctttgatgttatctatatgatggaggatgttcgtagtcctgcctatgataagacagtatctctggtttatctgttttacaataattcctttaaatattcggataagggctatggctccaccattgtcatgttgttgttattgattattcttgtcattactttcgttcagatgaaggtacagaaaaaatgggtgcattaccgttaaggaggttcatgtgaaacaatcagcttttaaatcaacaatctggatgcatgccttcttgattttagtggcaatgggcatgctgatcccatttgtttggatggtgttgacgtcttttaaaacggtaaccgaatccactcagatgaatcctttccactttttaccaagtaactggatggtgagcaattatacggaggctattcggactaataattttccgatactctatctgaacaccattttgatgatgttatggcgtatctttagctcggttatgttttcagctatggcagcttatgcctttgctcgactggagtttcctgggcggaatttcttgtttggtctggtcctctttcaaatgatggtgccacctcagttattcgtcattcctcagtatttgatgattgaccaacttggtatgcgcaatacgatttttgctctggtattcccaggaattgtcagtgcctttgggacattcttgctccgtcaatttttcatggggcttccaaaagaattggaggagtctgcgaaattggatggttgtaatatcgggcagaccttctttaaggtcatgttgccattggccaagtctggcttgattgccttagcgatttttacggctttgtttgctttcaaggatttgctgtggccattgattatcaactcagaggctgacaaggctaccctatctagcgcactttctaagattcagggagcttacgctgttaactatcctcagctcatggctgcaagtgttttggctatttggccgatgttggtactgtatgtgatattccagaagcagttcatccaagggattgcgacatctggtggaaaattataggaggctacaatgggaattatctttcatgaaaagacaaaggaattccatctttacaatgagtttattagctatgtgttgacggtcttgcctaatggtcatattggtagtttgtattatggaaagcgtgtaacagaaacagcttcttatcagtatgtacgtgaagatgagtatcgtgctttgacttcctttgtagaagacgatgaccgtttcttttcgctccaatatgccaatcctgaatttgcttgttatggtacaacggactatttttctccgacttttgagttggtgcagaaggatggtagcagtctatcgcactttgtgtatcaaggtcatgcgatttatgctgggcgatcggctttgaagggtcttcctcatctctatctggatgaggagggacaggcagatagtttggatatttatttgttggatgaagattcgcagacccggctggtcttgtcttatacgatttttcgagattatccagcggtgactcgctctgctcgttttgaacaactcggagaaaaatctgtctgtttgaaccgtgccttgagtatgacactttgtctgcctgatatggactatgattggttgcatttggatggggcttgggggcgtgagcggcatctgcaactatcgcctcttcatcaaggttgtcagtctatttacagtctcaaaggggctagtagtgcggagcacaatccctttatggctttgaaacgcccaactgcggatgagcaacagggagaggtactaggcttctcgctcgtctatagcggaaactttttggcgcaggtggatgtgagttctttccaaaaaacaagagtgagtatgggaatccatcctgagcgtttttcttggacattagataagggagaagagttccagacgcctgaggttgttatggtttatagcgagcatggtttgaatggcatgagccaaacctatcaccgcctcttccaaaaacatctggtacgtggctattggcgtgatagagaacgacctgttctcttgaataactgggaagccatgagttttgattttgatgaggaaacaattctttccttggccaaagaggctgcaggtcttggtgttgaactctttgtcatggatgatggttggtttggcaagcgaaaccatgaccgagcaggcttgggagattggacggtcaaccgagagaaattaccaagtggcttgacagggattattgaccaagttcatgctatgggaatgaaatttggactttggatcgaacctgaaatggtcaatagggacagcgagctttaccgagcgcatccagactggattttccatcatcctcagcatagtcaatcgcacggacgccaccaatatacgctggatttgtcgagggaggatgtttatcaaaatattcatgaccaactccatcggctgttggctgagcatgatattgattatatcaagtgggacatgaatcgctatatgacagaggtctttacatgtacacgggaggcggatcgacaaggtgagaccttccatcgctatattctcaatctctaccgtttatatgatagcctgatagcagcttttccgacagtcttattcgaatcttgttcaagtggtggagctagatttgatccagggatgctctactatgcaccgcaaacctgggtcagcgatgacacggacgccatggaacgcttgaaaatccaatatggaacgagcatggtctatcctttgaatagtatgggttgccatgtgtcagctagtccaaatcagcagttggggcgtgctactccactaaacacacgtgccaatgttgcattctttggaagttttggctatgaattggatttgtttgagtgtagccaagaagagttggaagagatgaaagagcagattgccttttacaagactcaccgtaagattttccaacagggtattttcactcgtctgaaaagtccattcgatggagaaataacggcttggcaggtccaatcctcggatggtcagcaagtcatcgtgggttattatcgtcggttgacaacggctaatctctcctatcaacgcttgtatttgcagggattggaagaggaagcggtctatcaccttgatggagaagtttatactggtagccaattaatgcatacaggtttgtcgattcgacatggggaccatgttggagacaataaggactttacttcttgtttgatggtccttcagaaacaacagtagcatccctattcctaggcccagctatcggctgggtctattttatgcagaaagtacatcaataagggcaagacctctacttatactcttcgaaaatcaaaattatccgttgtcaacttgccttgatgaactccagttctatcttcggcttcgtttcctaggctacttttgattttcattgagtattagatataagaattcttgaaaaacgggttgcaatgtgagaaaatgagagaataattcttcaatcaattagtgaggggaagggagataatgaatgaagaaatatgcttttcgtgaagggatgcgcgatgccattcccactgtattgggctatgccagtattggtctagcctgcggagtcgtatcggttaattcgggcatttctactgtggagatggggctgatgagcctattaatctatgccgggagtgctcaatttgtcatgtgtgccatgatttttgcaggtgcgcctttgttatccattgcagtaaccgttttctttgtcaacctgcgtaattttctgatgtgcttgcatgcgacaactatttttcaaggaaatcgtttagggtcgaatatcttgataggatcctttgtgacggatgaatcctatgcagttcttttgcgtaagcagattgagcatcataccattactccagaatggatgtacggaaataattttgcaagctatgcctcttgggttacattcacgactctcggcaatctgattggtggtctcattccaaatcctgagcagtttggattggactttgccttggttgctatgtttgtcggtatttttgcaggtcagttagaggctatggttcggaccattccgctgaaaaaaattggcttaattctgctggcagtcggtctggcctatatcggtctgtctatgatggtgtcgtcctatgtggcagtgctcttggcgacactactaggttgctttgtgggggtgatgattgatgataaaaactaacattttactgattattctaatggcggccctggtgacctgggtgccacgcgtcctgccttttgtcctgacgcaaaataaatctctccctccaaagttggtgaaattcctcagctttttgccaatcactatcatttttgcattgaccctctccagtattatggatgagaaagttggctccttgccaagttttctccctgtggaaagcttagctattcttccgacattttttgtggttttgaaaacaaaaaatatccttttagcagtcttggttggcgttgttacaaccgcgttattacgtttgatattttaggaggtttttatggtaaaagaaaatgccaaaggtgtcggactttgtttccttttggctttggtgggtcagtggttaggtcatttatttccacttgtaggtgggcctgtttttgcccttctaattgggatgggtctgtatccctatttttcaagtaaaaatgcatttcagtcaggcttaacctttacttccaagaaaattttacagtatgctgtgatttgtttgggatttggattaaacttatcagcggtcttggcagttgggcgtcaatctcttccaattattctttcgaccattagttttgctttgattttggcatttctgatgtggaaaatcttgcccatttcatctcatctggcaaccttgattggcgtaggtacctctatctgtggaggctctgccattgcggcgactgctcccattattcaggcagatgatgaggatgtggcacaagcaatctcggtcatctttctcttcaatgtcttggcggctttggtctttcctagtctggcaacttggcttgggttttcgactgattcgggtcaggcctttgggatgttcgccggaacggcggtcaatgacacctcctctgtgacagcagcggcttcgacttgggatagcttatatggtctaggcagtcagaccttagatacagcagtgacggttaagctaacacgaactttagccattatcccgattacaacggttttagcaatttggcaaacccgaggaaagggtctcaaggcagacaagaagtccctcttggcaggttttccgacctttatcttgtattttatcttagctagtctaatcacaacgatagcgggtggatttggtataggggcagattggtttgctccgttgaagtccctctctaaatttttcatttgtatggctatggtggcgattggtttgcggaccaatgtgtttgccttggtgaaaaatggcagagcggctctcatggttggtctggtttgctggctgggagtgacggtgttgacactggtctggcaagcgattttggggatttggtaagagaaatgtgagtgggaaagacatcatttcctatttcaaacaatttttgagaagtaaatcgcagtgccgcagggctttttgtcgttcggtttttagtaccgttgaacaacttaaaactagttagttttgtttaaaatgtaattgaattgtctttttaagtaggctgtttacacgatatttgtcttcctttatataaatatgatagattttcagtaaatttttcaaaaaaacctcaaaaataacagattttttcttgtatctttgaggcataaggagtataatggtgacggtattcaagtagaaattttatatactctggatgaaaacattctgtctactttaaaataaataatctactgggtatccttctgctaagtttttaaagcaggaggtgtgtttttgtacatggtgttacaggaaccagaaatgatggcattcgccagtaaaatataggaggatatcatgtcttataaagatatgttcagaaaagaacaacgtttttcttttcgtaaatttagctttggtctagcttcggcagtcattgcaaacgttattttgggaggagcaatcgcaaacagccctgttgttcatgctaacacagtgacagaagcagagacagctgtagcaccagctaaccaagaccttggaaatgagactaaaacggaagaagaacccaaggaaccaatcgaagcagttcgcacggacatggaaaaccgtgcagctgaaatcttgccggaggcgctgaatgctagtgtaacaaaccaagcaccagttattccgactattggagatcttcctaaagatgcgagtggtcagaatgttcatggtaaggcaacggataataagatttatcgtgttgtatacgtttttggtaatgtagcagggactacggagacagaagatggtaaacaaaatgttgctccaacatttaacagaaatgatgcaactaaaacttttccaatcacagatccagatagcgacattcaaactatttcatacgaagttccagctgatattgcaagctataccttggatgatccaaactcaattgttactaatggcacctcacctggtccagtatcttacttagatggtccaaatgggtcagccactctcacacaagatggttatctaacaggaagtttcccttggggagcaggagacctagctggtcgtcggattaaagtgacggatgccactggtaatactactaagagtaatccgttctatatggttgcatatacagtcaagccagtagatgataaacctctagcagtatcaaactcttctgagctgacggaacaggctatttttgataagttggttgtcgataagtctgctaaaacaacttcaaatagcgctcttgtaattgattctagcaactacaaacattcaattgcaggttatcgtaccgtaaattctgatggcacaaaaacagaaacagtagaggaaacaaatctatctgatttcccaactgaaggtaaatacgaagttcgagtaaaaacaaccaatgtttacggtcaaactatctacaactggattcctgtaaatgcctataagttggacacagcgaaggatgctgaaattcggaagtatacagacaaccaagccccaattcatgctataatgcaaattggtcaagctggagaaaaggcagcagttatattgaaggatattccatccgatttcagtattgaaaacttcaatttgaaagatggtgtagcagatgagcttgctaaacgtaacttggaatttgtaagaaatgatgcagtggcgacaactgatactgatggagatggcgccaaagaaggaattgttggatatattcaaccaaaaactggcggtgcaaacagtggggtagccacttatacaggatcaaataatcttacttatggcttcacttacaaagctgttgagacaaaagataaggcgaatgccacagaggctaaaactctcgaattagattacaccatcttattcatagatactaaagcaccagtcatgacacctaaatcagagtacatccgttttgttggtgaagagtatacggttagcgtcccaggtacggataacgccttccttaataccggcaaactaaatggaactctctcaattttgaaagatggagagtcaggttctcttgtatcatcagacttaggtacaaacactaagattacttcagaactggatcctacgggagcaactgcaaaccaaggagatgacggtcaatcttcaactaagtttaacgttaagattacaggtaccggacctgctacagaaggtaccggcacttataagcttcgtgttggagaagataactatccttttggtccagaggggaaacttgttgatggaaataaaccagaaaatgtaggtttgacatctgtaaaagttaccttcgtaaaacatgctacggtgtcaacaccagtttctgttgaaaatccagctaacttaacgccagaagaaaaagccgcagttattgctcaaatcaagaaagacaacgcagacaacgaaagattgaagggcttgccagattcagcatttacagttaactcagatggtactgtgtcagttgactacagtgccggtggtgtcaatgttgatggtgcgacagacattattaagaatgctaccacaaacttggcagatacacggaatgaagcaaaagcagaaatcgacacaaaattagctgaacataaaaaagctatcgaagcaaaacgggatgaagcgttttctaaaattgatgatgacatttccttgagagcagaacagagacaggctgctaaggatgccgttgctgcagctgctggggatgctttgaaagaattagacaacaaggcgacagaagcaaaagaaaaaattgataaagctacgacggcctcagaaatcaatgatgctaagactaatggtgagattaatctggacagtgcagaagcagtaggcgaaaaagctattaaccagtcgaagcgcaatcggcagaggacaaaggcgtaggttcaatcgcccaagatgttcttgacgcagcgaaacaagatgctaagaataagattgctaaagaatccgacgctgctaagtcagccattgacgcgaatccaaacttgacagatgcagagaaggaatcagctaagaaagcggtagatgcagatgctaaagctgcgacagatgcaattgatgcttcaacaagtccagtcgaagcgcaatcggcagaggacaaaggcgtaggcgccatcgccaaagacattcttgatgccgcgaaacaagatgctaagaacaagattgctaaagaggcagaatccgctaagtcagtcattgactccaatccgaacttgacagatgcagctaaggaagcggctaaatctgaaattgataaagctgttgaggaagcgattgttttaatcaatggtgttagaacttatcaagagttggaaaaaatcaaacttccaatggcagctctaattaaaccagctgcgaaagtaacaccagtggttgatccaaataacttgactgaaaaagaaattgctcgtatcaaggcattccttaaagagaacaataacctcccataaggaacagagattaatgtttctaaagatgcttcagtgacaattaaatatccagatggaactattgatttgctatcaccagtagaagttgtgaagcaggcagataaaactgctcctacggtcgcaaatgatggcaaaggtaatattgtgattgtaccgtctgaaaaagctgttgagcttgttgtttcatacgtagataacaatggtaagtcgcaaactgtagttgttacgaaaggtacggatggtttatggacagcaagtaatacagtggtgattgtggaccctgtgactgggcaagtaatcgttccaggttctgttattaagccaggtacagttgttacagcatactctaaagacgaggttggaaatagttctgattcagcagaagctgaagttgtagcagtagacgaaaataattctgcagcaggagtgaaagttaaatcagttactacaaatgctaataatgttgagaagaaagctaagcaattaccgaatactggtgaggaagcaaattcagcaacttcactcggattagtagctcttggactcggattagcacttcttgcagcaaagagaagaagagacgaagaagcttaagataagctcttcctcagaactcttttggaagccgcaattttcctagaagatagtagtatgatactctttcatagcaaggaaattccctcgctatgattggtaggtatcagttattatctatcgaacccccaaaatccaaagtcattcgactttggatttttttgatacgacatgctcgtcatacctaaaaaacagccttctcttgcgagaggctgtttttcatgcttttaatctaaaagtctgcggagcttttttcaataaaatccagtaaccgatgctaacataggcaatcatagctagggaaaccagcaggatataggtgtggctacctacattgattcgggtgttgagataggccacccagtagagagcaccgctaagaaatttatagaggggattgaccacatccatgtcattggtaaaaggctggaggatatagtagataaagagatcgtggaaggaaaagagagcggtcagactgatgaggagcagggcagttagtagaatggtttccaaactaaaggcaaaccgccccagcaccatgatagccaaaaagaggctggtcgcaaagatgagattgagcttgcaggtctgcaaaaatcggtagttaaaaccagcgataatagtcttggcttctcgatagaagggatagtgaagcatggaaatatcgcagttaacaaagaccatctgagccaccaccttgcccgacgaagctacgtacataatcatgaaggaaagcggtaggaattggagcaagtaggcttccgtaaaggtaaacggatctaaaaagtaacgaatcccctccagggctgccagaatcacgactactgccaagacccagttctgcaccttcttatagaggacttttttgtagcggtcaaatagcagagcatttaagtaggtcatgccagacaggtgggacaggtcctttcctgttttcgcattgagttttgcctgcatctgcaaaccctggcgagtgtattcatttcccttggtcatctcaaaaagtttcttatccatttgcaaggactcgtccatacagtaggaaagatagtctaggtggttggtttgttgcttcaaataaccatagctaaaccaaatcagaaatggttggacaagcaggatagggactagcatgcctgaggagagctgattacggaagacaatagccaaaacatataaaacaaaaacaaacgcgatccatagccaagcatgccacgaattgcgacgggaaaagatacgacgttcaaagagcagacgattgagggcatggccagctagatgacctgccagcactgtcatcaaaccaataggaaaaactaaccactccttggttatcatgcaaaaaatggttgaggctggcaggtagtaaatagtggtcaggataggctcgataaaaagttggctttgaagaaagctggattgtgacaggctgaaattctgcataaattctcgatctgctttagagataacagggtctaagctcttccccaaacgatagcttagtccgacaaacaaaagccagaacataaagccaaggagccaagtgtttgggagaattttccaaaaggtcagctccccattgactagcatattcatccagaaagaagcatggtagaaatgaaagagcaaccagaagcccttgatcaggaagcgactggggatggataagatgtgcaggaccaaaaagagactagacttaaagctgtaagacttgaaaatactctctggaatgcactttcccacaagcggcagtttccgaagatagtagaagaatccattgactgaccgatggaggttatatttttcctgataccaagaataacgtaatattgttttcataggtttctcctaatctgctgtcagcaaggcaactacttcctgttcgaagtcaggatcatggagtttgtcgctcggaactgcttgcaattcttggtgatggagcaaaacaatctcgtcacagaggtcttgagccagttgtaagatatgggttgaaaagataataacggaatcctttttagcctcccgaatcagctgtttgaactcgtgggcagccacagggtcaaaggaagtcagcggctcatctaagagaaggacaggtggctggacaatcagggacaggagtagctggaccttgttctgcataccatgggaaaaatccttgagcagacggtgctggtcttcttctccaataccgaccaagtttagccattcttctggactgcgaggagatttgagtttatccttatgaatgtccatatagaagcggacaaactcataggctgtcataaaggcaggtagttgtggataggtctgggtaaagccgatgtccgtattatcgtagtcaagagtttcttcgcctttcacaaactgaatcgagccattatccaaggtcagattacgggcaatgcagttaaacaaggttgtcttaccagccccgttccgtcctagcaagccgtaaatcttgccttgttcaaattgaaaactggcatcctccagaatactcttgtgatcaaattttttagaaatagaagacagtttcagttgcatagccaatctcctttgttatattgttatggttttatcatacaataaaaaacaaaaaaattcaagcagtttttgcttgaatttttcagtcattaaataattagtagtgtactactcaaagaaaatcgaactcagactagctccaaaggttcggggaacctttggaggttggagataaggcgaacaaagttcgctacaaaaaggttcggggaacctttggaggttggagataggggaacaaagttcgtgccattagatgtagatagaacgctgtaccttttattttcgtgtagcaggctgtaaagctccactggagctttacactcatcaaatcaagtcaacaacgtctgagtttgatttatgaagagtaggaactaccagccacccagccagtcgcaaggcagtaggtaatgttaaagccaccggtgtgggcgttgatgtccaagacctcaccagcaaagtggagaccaggcaccttcttgctttctaaggttttgggattgatttccttgaggtcaacgcctcccttggtcacaaaggacttggccagggacatcttgcctgtaatcttgataggtaagactttgaggagggtgaccagttcagtcaggtctttttgggaaacttgcttgaccttgctatcgtagttttcagcgaaaaagtctgctagacggtctggcatgagttcagaaagggtattcttaacggatttttccctgttcttttctaaatgttcaaacaggtcttggtcagaatgggtcggcaatacatcgagaaatgcggtttcgccgcctttgacaaaactggacaagcgaagagcagcgggtcccgacaggccaaagtgggtaaagagcaggtcgtgggtgatgacgtgcttgccgtaggtcagggtgacgtcgtccagggaaattccttggagcttcttgtgggggaagtcggtcaggacggggctttcagcggcttcaatctccgtgacttccagcttgaagtggcgggcaatgtcgtgtccaaaaccagtcgatccggtggaaggataggtcttgccaccggtggtgacaatcagctggggagctgtaaagacttcctcgctggtcttgacatggaagaggtcatccatcttgcggacggacaccacctcagttcctgtacggatgtccacgccattttccaacattttcatctccaggcacttgataatggtctgggagcggtcggtggttggaaagacacggccgtggtcctccaccttgagcttgaccccgttttcctgaaagaaattcatgatgtcatggttgtcaaactgagaaaagacgctgtacagaaagcggccattgccaggaatgcctgccagcaagtcttccagtgtgccgttgttggtcacattgcaacgtccgccgcctgtgccagatagtttcttgcccaaacgcttgtttttttcgagaagcagggtcttcttgccataaaaactagaagaaatggcggccatcatgccagcaggccccgctccgataataatggtatctactgtattcatgcctttattgtatcatattttcatcaagaaagtagtttgagtctttgctatgatttgtggagtttttccttgagattgcggaagaccattgacgggttaggggagtatacttaaactaagggaaattagtttttatcaggagcctgtatgtacaagcaaagtaattttgtggaaactgcattgtgaaaccaggttctaacaactccgtctgtagcatgaaagaaagtaggtagaagaatggtaactgagcaaagagagtatcgttttccagaaggttttttgtggggatcctccacttcagggcctcaaagtgaaggaagtgtagctggtgatggaaaggggtggaataactgggattactggtacagtcaggaacctgagctctttcaccagcaaataggaccggaacaaacatcgactttctatgaacatttccagtcagatttggatttgttggtggaaacatgtcatagtatttttcgcacctctatacagtggtcacgtctgattccggaagggataggcgaggtcaatccgcaagctgtggagttttatagggctgtatttgcaggtattcgagagcgtgggataaagcttttggtcaatctttatcatttcgatttgccttatgtcttacaggaaaaagggggctgggaaaataaggagattgtctgggcctatgaggcttatgctcgccagtgtttcagcctctttggggatttggtggatcattggattacctttaatgaacccattgttccagtagaatgtggctatctaggaagctatcattatccttgcaaggtggatgcaaaggcagctgtggtcgtagcgtatcatacgcaattagccagttctttggcagttcgggcctgtcaccaactacacccagaccacaaaatttccattgttctcaatcttactcctgcctatccaagaagtcagagtccagaagatttacaggcagcacggattgctgagctatttcaaacgagaagctttttggatccatccgttttgggacaatacccgagggagctggttgacattcttgaaaaacacggtttacgtccagaaaccacagaggaggaattgaccattatcaaagaaaatagggttgacttcctgggggtgaattattaccagcccctgcgcgtgcaggctccttcagaagatggatggaacggagagcctactttcctatcccaatatttccagccttatgataagcctgacaagaaaatcaatccccatagaggctgggaaatttacgaagaagggctgtacgatattgctaaaaatatccaggaaaactatggaaatatcgaatggttggtaactgagaacggcatgggagtcgaaggggagggtgtttttgaagaaaatggcatgattcaggatgactatcggattcacttcatggaagaccatttgattcagctccatcgaggtattgatgaaggggcgaactgtaagggctatatggtctggacctttattgactgctggtcttggttaaatacctataagaaccgatacggtttggtctcgcttgaccttcaaactcagaagcgtactgtcaaaaaatctggatattggttcaagcaagtgagtgctaaaaatggttttattagatagaatgtatatttcgtttctgcataacattgcattgagataagatgcttttgaggtttgtgattattcactaatgcttggtaaggaaattcccctagatttgacagggatagggttctgtggtaatattttaatgatacaaactatgagaaatgtaagtaccgaggatattatgggaatcgaaaaaacagtcagtgagttagctgaaattttaggagtgagccggcaggctatgaataatcgtgtcaaatcacttcctgaagaatttgtagataaaaatgacaagggtgtgaccgttgtaaatcgtgctggcttgattaagttggaggaaatctacaaaacaaccatttttgaagatgagccgattagtgatgaagtcaagcatcgtgaattgatggaaattttagttgacgagaaaaatgctgaaatcattcgcttatatagtcaattaaaagctaaagataagcaacttgccgaaaaagatgaacaactcaaggttaaagatgtgcagattgctgagaaggataaacagttggatcagcaacagcaattgacactaaaagctatggccgataaggaagttctcaagttggaattggacgaagttaaagcacaggcagaagaagtgcaagctaaaggcttctttgcacgtttatttgggaaataaaaaggtccgggggacctttttatcatgagcttgaaaacaagagagcgaataaaggtccgggggagtgaaacagcctggggatagactgtttcagcccgagctaaaaactggaaaatgatatgtgatataaaaagattggtgggaaccaatcttttttagtttaagtagtgagcacaattgaatttttatttttcattatattaattgggctcaaagactctagaaatcagaaatgaaaagggatacaattaagacaaggaggaaaatatggttgataatcgtaccatggcgattctgatggaattgtttgcgactcgaaaagaaagtttgtacgaacttagtattcaaacaggaattgaaaaggagcagctacattctaatttggaactagtcaatcaattgttgcaagaacattccttcccgcagatacaatacaaagatagcgagtttgttatttctacggagctttacaatcaaaaagaaagtgtattttcgctctttcgcaatcgccagatctatctttcgcaagaagaaagacagcttcttatctatctttatacctttatccgaaaagaatttgtatcaaacgttcactaccaagaattattgagtgtgagccgtaacacaacattgacggatattaagaatgtaaaggaactttgcttggactttcaagtacgattggaatatacgagggcgaaaggctatcatctaattggtcgagaagaagataaacatcgcttggcgctttatgcactcagtaattgtttgcagtcttcgattggtgtgtgggctttggattatattcttaaatcttggggtgaggaaaatcctattgaagaattgaaaatagtgagtcaacaagcttgcaattattataaagtctcagctttagaagagagattggatgaatatttgtattttttgatatttttatttatccgtcaggcgcgtgttggcaaccgtattaactggaattttgaaggaaagggagggtttgtaaaagattttctgcaacgcctttggaaattattacgtttaaaaagtactagcacattagaattaaatgctgcgacacaagagtatctgtcacatttactgcaaggatgcttagaaggtgagagcggagaaaaggatgatctattttaccacttgactgtagaaatagtggaagagatggaacgtttgtccttaattacttttgaacatcgctcggaaatgattgaaggtttgcaacgtcacctaattcctgcttactaccgtttaacatctcgtttggtaaatgtcaattcatatactgaaaccatcaaagaagagcatgccgacttgttctatcttgtaaaaaaagctttgcgacctttggaagagcatctaggttttactataccagatagtgaggtatcttattttgtcatccactttggtggctacatcgaagcaggtcaacaacgttcatatcgttatcgggccttggttgtttgcccaaatggagtgagctcttcgctgattgtaaaagaaaatctacggcaactatttcctaatatctattttgccgatacccattccttacaggattggaagatgctagacatgacagactatgacatggtatttggaactatcaagctgaatatagagctaccatttttcttggtatcccagctgatgacctctaatcataaaaaagaattatttcatttggttaatcagcatttcccaaatgcggcttattttccgattgagattgagcagttattatcacttgttgggaaacatgcaaccattcatcaggagcaggctttaaaatatgaattggtgcagtttctcaatcaacgctcccatgagcaaaggggaaggagtcctatgttagaagaattgattacaaaagagacctttcaatggtctgaggaagttttagactggcaaaaagcagttgccctggctgcacgacctctggtagataaaggagctatagaaactcgatatattgatgctatgatagcgaaggtagaagagtttggtccttttattgacctaggtaaaggaattgcgattccacatgcacgaccagaagatggggttaatgaggtagggatgtcaatgttggtattggataagccagtttatctattggatgaccctagtcatgaaattcggctgttcatttgtattgcagccgtggataatcaaacccatctcagagcactctcgcatttgacaaaaattttgcgagaagaagaaaatattcaacaacttgtcggcaccaaagaattcgccgacgtacaacatttattaaaggaggaacagtaatatgttacgaattggaacagcctgtggttcaggtttaggctctagctttatggttcaaatgaatattgaatccattttgcgagatttaggtgtatcagatgttcatgtggagcattatgatctaggtggtgccaatccgagtgaagcagatgtgtggattgtcggacgtgacctggctgattctgcaactcatttaggagatgttcgaatattgaatagtattattgatatgaatgagttgagggaacttgtcacggctatctgccaagaaaaaggtttggtttaaatcgtatacacaggggatgacccgcaaagataaaattataaaggagacagaaaatgatattggattttctcattgatattgctaaaactccggcaattctggttgctctcattgctattctaggtttagccttacagaaaaagcctgcagcagatttagttaaggggggcttgaaaacttttgttggttttattgttgttggtggcggagcgaatattattgttggctcgcttgagccatttggtcaaatgtttgaacaagctttcaacttgaaaggggttgttccaaataatgaagctattgtagcgatggctttggataagtatggaactgctacatccttgattatgttgcttggaatggtcttcaatattgctattgcccgctttacacgctttaaatatattttcttgacaggacaccacacactatatatggcctgtatgattgcagttatcatgagtgttgcaggattcacttctgtcggcctaattgtgatgggtgggttggctttaggtctgattatgacactctccccagccttcgttcaaaaatacatgattcaattgacaggaaatgatcatgtcgccctaggtcacttcagtgcacttggttactggttgagtggtgtagtaggcggtttggtcggtgataagtctaagtctactgaggatattaatttccctaaaggtttggcattcttgcgtgattcaactgtcagcattgccatttctatgtccttgatttacatgattgtggctttgtttgcaggcggtgattatattaaggaaaaccttagtggtggtactaacagcatgatttacgccttgaccctaggtggaacttttgcagcaggtgtttttgttatcttatctggtgtacgcttaattttagcggaaattgttccagccttcaaaggaatttcagagaagttggttccgaattccaaaccagccctagactgtccagttgtttatccttatgcaccaaacgccgtgttgattggctttatctctagttttgcaggtggtattgtcagcatgattattcttgccttgactggcggtgtcgttatccttccaggtgtcgtaccacacttcttctgtggagcaactgcaggggtcatgggaaatgcgtcaggtggtgttcgtggcgcagtttgtggtgcttttatgcaaggggttctcattagtttcttacctgtattcttacttcctgttttgggagaccttggttttgctggttcaactttctcagatgcagactttggtctttctggtattttcctgggagtgctagctaagaatggcggtatcctcacagtttcggttggtatctttgctgtcttggctttgatgcttggattgtcattggtgaaaaaagaacagaaagaaggataatatgactagtggtacagctgatttgaaacgatttgccaaagaaattcgctaccataccttggcgactttgaatcaattaggattcggtcattatggtggtagcttatcaatcgtagaagtgttggctgctctatatggagaaattctggacattcgtgtccagaatttctcttctaaggagcgggatcactttattctgtctaagggacatgcaggtccagcactttatagtacgttgtatttgaaaggcttctttgatagagattttctcttgtcgctaaatcaaaatggaacacatttgccttcacaccctgaccgaaacttaacgccaggggtggatatgacaacgggttcgttggggcaagggatgagtgtcgcgacaggtgttgcttatggtaagaagatagaacagtcaccgtactatacctatactctggtaggggacggggaattgaatgaaggtcaatgctgggaagcagctcagtttgcagcccaccacgaactatcgaaaatgattctgtttgtggatgacaataaaaaacaactagacggtcgtacccatgatatttgccaaacctttgattttgttgaaaaatttcaggcttttggttgggaatcagtgcgtgtgaatggtgccgatatagatgctattataaatgctattctaacaatgaagtcaagtaagtctcctcaaccaaaatgtatcgttcttgatactactaaggggcagggagttaccttcttagaagaattagaaagcaatcaccatttgcgtttgtcgggtcaattacgggaagatttagagcaagtaacacttgttttagcgagagagttggaggtgacggaatgagacagacaaaggagatgcgactggtttatagtgattttctagctcaggtagggcaggaagacacaaccatagcagctattgaagcagatttatccagttcaatggctaccaacaaattgtcctctgttctggggggacgctatgtcaatgtaggtatcatggagcaggaaatggtaggggtagcagctggattatctcttctaggatacaagccatacattcataccttcggaccatttgctagtcgtagagtctatgatcaggtgtttatctctctagcttatgcccagctcaatgccacgattgtagggtcggatgcgggggtatcagcggagatgaatggtgggactcacatgccgtttgaggagctgggcttaatgcggctcattccaaaagcgcgtgtttatgaggtcagtgacgatgtcctgtttcaagctgttcttaaagaaaccatcaaggtagacgggttgaagtacattcgtaccattcggaaagcgccaacgcctatttatcaaggtggagaagattttagcaaaggctactgtgtccttaggcaaggggaggatatgaccttgcttgcgagtggtattatggtagagcaggcattaaaggcggcggatcagttagaggctcaaggagtatctgttcaagtcattgatctttttcgtatcaaaccaattcatgaagacatatcagctctattatcaggaaggccagtattaactgtagaaaatcataatcgaattggtggcctaggtagtagcatttgtgaattaatggctacagatttaacgaccccagtacatcgaattggtattgaggaatcttttggtcaagttgggcaacaagcttacttaatggatgtatatggtttgacagcagaatatattgttaaacaagcacaattaatgttacaacaatagtgagatagtgattcgtattttatgtagcctttcgatttactttggcttggaaataggaaagcaaatcaaatgtaagaaatcaagctccacttaggaacttgattttttctatacttcattcattgctttcacaatcttccatccttgatgaaggcttgcaattcttgctagaatatgggacactagaatcatgaaaaagatacaacgtgaatttcaaaaaatatattacaacttagacaagattctcttgctcttctttaccctgtttacctttatggaatttgtttggataccgctcaattcatggatttctgagggactcttagctatgacagggcatgcctacctttcaccgacgaatttgttgtcggtgtttgctgaaaatctgctcgtgacaggcttgtttattctcctcttttttgtcaacattgccattgcctatctagaattagctctattgttcacaggggtttggcaactgttggatgaaaaagtcaagcacctcaccgactatttacgggatgtacgagatagtatggtggcgattatccgtcacagtagcctaccaaaggttctatttctgctcttttactcagttattcttcttccatttttacgccgagtattaaatatctattattttaataaaatcgtagtgccccaatttatcgtagattacctatccaacacagtctggctaggaatattgattttgattttcctcctcttgttcttctggcttgcggcacgcttcatgtacgctctgccaaacatttattttgaacacaggggtgtgaaggagtctatcgcttattcttgggagaagaccagaggcagaaagcagatcggttcattgttccgtctaatttggttggttacttttccagttctcctatttacaggagtaggaggactattctatcttgtgcaactgttagcagagcattttgtaccaagtgcttcttactggctggcagttgtctgttacgcacttctaaaattagcctactacggagtagttgcactcttcatgatgggatttgtcagcctcctaacaggaaaacaactaccaatctaccgccgtaaacgcctccgtcatcaccttcgactagccattttgctcgtatctggtctggtgttcggtacccaaggagcgcttgccctctactttccctttgacactctgccggttaccatttctcaccgaggtgtcgatgacggcaatgctgtccagaactctatcgaggccctagagaaaacctctcagctcaagccagattatattgagatggatgttcaggagacgaaggatggtcagtttattgtcatgcatgatacggatttattggctttgacgggcaatcccggaggtacacatgactatactcttgcagagttgacagggatgactgcatcagaaaacggcatggcagctccagttccttcttttgatgaatatcttgaaaaagcggatgagctgggacagaaattattggtagaaattaaagtgaccaaggcagattcgccaaaactcacccagaatttcttaaaaaaatacggtcaacgtttgattgccaaaggacaccagatgcaatcattagattaccgtactattatcgaaataaagcagtatagcgagaaattagtatccttctttattcttccgttcaattcaatttatccgacgacggttgctgacggctatactatggagtatacctcgctggatcaaaattttatgaccaagtcttggattcgagggaagtcggtttatgcttggacaccgaatgaagaagagagtatgaccaagatgttgctgctacaagtggacggtatcatcactgacaacatgaccgacctccaaagtctgatggaggaaatgaaagagaatcgacgctatccagacctctttttccagcaatttcagtctttgatttataattttgaataaacaaagagacgcgagggcctggcccaatcgcgtcttttctgtcttaaaaaggtaatttacctgcaaaggcacctagttttttctgagttgcctcgtcaacttttgtaagtgcagcgttgacggcttggattgtcatttcttgcaaggtttcaaggtcgtctgcatccacaacatcagccttgaagtcgatagaaaccaatttcttatctccagtaaaagtagcagtaaccaagtcttgtacagagctaccagtaaattgagtagcagccaactcagcttgactcttctccatttgtttttgaagtttttgagcttggcgcatcatgttttgcatgttcatcataagatttttaagattcctttcgtatcaaggggttagaccctgtttgtaaattttccttgccttatgttaaactttttcaaaggcagaggggtagtaaatattataacatgttttatgtagataatgctaccttcttaaaataagttatagtcagcaatatcggatataaatttgacatattaatctattttaaattgactttgagggataaattcgctataatataagaaaaactggttataaccagaaatcacggaggaggagctatgttccgtttagcaaaagaagaacttgaaaagttgggagctattattacggcgaccgaaatttaccaacagccaggcttatggaaggaagcgtatcaactctattttgaccaattggaaaaaatcgagagttttctaaaatcaatcaaggaaaaacatgactttgttcacgttgtttttacaggtgcagggacttctgactttgttgggcaaagtattgccaactacctcaaccaagtcaatgacttgaaacacattcgtttttctgccattggtacagtggagctggttagtcgcccacatgactatttacaggcagatgtgccaacggttttggtatcctttgcccgttcagggaattcaccagaaagtgtggcagcagttgaagtcgctaagcaattggtagataaattgtatcaagtgaccattacctgtgcacccgaaggtaagttggcactagcggctgaaggagatgctgaaaatctcctgctcttgcaaccggctggatcaaacgataagggctttgccatgacaggttcttacagctgtatggctctgacagccctcctcgtcttctcgtcagccagtcaagaagaaaaagctgcttgggttgagatcattgcccgtctaggtcaagatgttttggaccgtgaagactacgtgcaagacttgattaaccttgattttgagcgagtgatttacctcggttcaggtggtttctatggtcttgcccacgaagctcagttgaaaattctggaattgacagcaggtaagattgcgaccatgtacgagtcaccactcggtttccgtcatggaccaaaatccttcatcaatgaaaagaccttgattttcctctttgcctcaaacgatgcctacactcgtcagtatgatgtggacttgcttaatgaagttcatggtgatggcatagcagagcggatagtggcattgtcggctgataagttagtcggtacagaagcagccaactttgtcttggcagaaggcggagcagatctgccagatgtcttcctaaccttcccttacatcctctttgcccaaacggtatctattatggcagccattaagtgcaacaacttgccagatacaccatctccaacaggcaccgtcaaccgtgtggtgcaaggtgttatcatccatcctttagaaaaataggcagatgcattcaacgatgaagaaacagagctattcggtagagttttaacacataaaaaacacatccgaccacctgaatatcatggtacaataataatatataataaaatatgattaggacttatagaaatggaaactgcaaataaaaaattcagatatagtattcgtaaatttaaagtcggcgtaggctcggtgctgattgctacttgcttacttggtgcgggagtctcgacaccaaccgcttttgcgacgacagagacttcaacagctactcaagttgaagcaatggcgaaagttgaagaagttcagaagcttgtgaaagaattagaaaaagagctgggggaactagataaggttccaagttatggtgatgctcaagattattcttatcagaaggctttgtgggaagagtttttaagaattggaaaagataatatggactatgcttcaaaaatgaaagcagatgacaagtttttccataaggttaaaggggatttgaatgattttaaatatcaaataaaagtggaaaactatatccgtcaggttgcagaattgcgaaagaaataccctggtgataatacaattgaggaagaatataatgcgcatttaaagcaagacgaaggcaagagtatagctagccaagagggcgctaccttaagagactacgttgatagagaagcaagtgaggccatgggcagaattaagcaacgagttgctgaactggaaaaatcaaaacaaccccagccaagtcccgcagatgagccagctccagctccaaaagaggaagaaaccccagctccaaaagaggaggacactccggcaccggacgcagccccagctccagctccaacaccggaagtggatccagctccaactccaattccagacactccaaaggcagaggaagaggctccaactccagtaccggacactccggcaccgaaagaggacgaagttccggcaccaattccagacgctccaacaccgaaagtagaagaggaaacacaggagccgaaaacagaagagaaggcaccagagacgaaagaagaaactccaactccagtaccggacactccggcaccgaaagaggacgaagttccggcaccaatgccagatgctccagcgccgaaagcagaggaagaagttccagccccaactccaatgccagaaactccaatggacaaaccgaaaactgataaagtagagtctgacaaacagatgccagaggctaagcaaccagaaatggagcaaccgaaagcagaagacatgccgaaggaggaaatgccaaagtctgagcaaccaaaatcggaagactctgcacctaagacagcagttccagaagtcgcaccaaaaacagcggaaaaaccaaagctagacttcacaacaaaagaacgcaaggtagaagaagctctccctatcaaagaagaaatcagatatgatgcaagcctaccgcttggcaaatcataccttcttcaagaaggaaaagcaggtaaaaaagtatctgtttatcaagatgtcatagttgatggtaaagttgtcgcaaccaacctattatcagaaactgttgttgaaggtcaaaatcgtatccttgtaaaaggtagcttggaaatgaagaaagaagaagtaaaaacaactccttcagtacaatcaaatccgacactaagtcataagggcgcaccttctgcaaacaaagcaaccctacctgcaacaggtgaacagcgcaataacctagccttagtaggccttggtttagctggaattagcttggcggtagtcgctacagctataaacaaaaaatctaaagatcaaatctaaaccattatgaaataataaagaggcagggcggaaacgcccagcctctttttagaactgaaaatcaatattatactcttcgaaactcaaaatcagacgttgttgacttgatttgatgagtgtcaagctccagtggagcttgacagcctgctaccataaaataagaaagtagcaggggtatatctgctcttggagaaacgaacttcgttcactctatctccaaccttcaaaggtttccaaaacctttgaaactagtctgattttgattttcattgagtattagtgcggtaaaattaactgtgattgacttaaatcaaggtggatttgccattgagaattatcccgaacagtacactcaaagtcggttgtatagagaatcaactccaagacatcgccttttttcagctgataaatggtcggctgcagtttccaggtcagattcatccactgtccaggcaccacttcctcgacagtcatcaggtcggtgcggttttgcaggttcataaagcccttggttaccaagcgttgtggcatctccacatagggcaactccaccagattttcttgggcatggtaacgaccgttgtctagactcaatcttgctttaggcgcagggattggggctaggcgttttttatttcccttgtccaatagctgagcggataagaggcctttagctacactagaagcgacacggagtttcagcgtgacctgcccgttaagcaagaggccctccgttacaggcagttcaatgctgatttgattggctttgcctgcatagaggtcttggtggaaggcagagtaggatttgccgtagcgttcaaaatcttcttgggtatactgattggcaacggtctggcttccagtacctagtggcaagacagtctcgttttcaccgccaaaggtgtccaaggtcgtccaagtttgctcaccgctgttgtcctgccagataaccgttggcagttggtagttgttctcgtagcccagtagtttctgactgagcagggcgttcatggactcgcggaagtcgatagactgccagttgttcatataaacgtgggcaccgttgtggaagaagaggtgcttcttgatgtgactaggtagggcatggaacatattccagacatggattggcttgacattccagtcctgtgagccgtgggtaaagaccacctcacacttgaccctatcagcgtggagcagataattgcggtcatgccagtattgattgtagtcaccgctggtgcggtccagggcagcacgctcggcagccagtcctttttcgtaggctgctttattgcggaggaagtcacctgcttgcaaactcttggagtaggtcagggcggtcaagctgtccaaatcttcgcctggatagccaccagggctggtcaccagcccgttttcacggtagtagtcataccaagaggaaatccctgcttctgcgatgatgacttccaatccgtccacgccagttgttgccaaggcattggacatggtaccgagataagacagtcccgtcgtcgctaccttaccattggcccaatcggccttgacctcaagcgagcgagtgtggtctgtgtaggccttggtgcgaccgttcagccagtcaatcaccgctttatagccctccacctgttggtagtcgccagatgtcatgtagcccgtcgagcccagcgtgccaacaccagacacatggaggctggcaaagccgcgagcgaggaagtagtcattgagggagtacgaagtaatgtgccccagtttttcagtagcagggctgacaggcaggttccgttggtccaagtctaacttggtgatgctggcctgcttgacctgaatggtaccgacttgtttttcagccagttccccttccatcttatgcagagccttatcgctggctacatcgttaactccttgatgataaggactatttgtaatcaccgcagggattttcccgtcaaagtgaggacggaggatggacagcttaacaatatctgtctgcccagtcccagctgtatcaacaggcgtttcgacatagaccacctcacgaataaggtttttggttgaaaaggttgccatagatttgccgttgaagaagtggtagtgattgtcctctggaatcaggtcatcgctgactagctggtcaatcaaggtgtttccagacttggtgcgagtattgaggagctggtagaggttgtcaatgatgtccccatagacaatcgggaagttgcttttctccacgaaatccatgacatctgtataatccataccaggcacaaagcccagcaactgaaaggcgacttgatagaaaatctggtcagtcaactcacggtcagactggaagaaggtcagaagatctgtgtcccattctgcgatcatgtttgacagggcaaagtcggtgtttgctgtcaggaaatggcactttctgacaaaggtttctaaatttgtcttactacttgcatcaggaatcagttgaaatcccagagtatcaagttcttgcaagtagacggaggtctctttttttatgaaagaaaattgattaaagcgcataaattctcctcttttttaggataatagtctataatagctattatatcggataagtcaatgtttgtctaaaaattatcagtatatatagagatattaatgtataaaacgacgatacaattacttgtaaaatgatgaaaatttttatacaatattgtagaatgactgaggagtgaaatgtatcgtgttgagaaaaaatgaagctatagtccctattttacgtattaataatagggctattaaccaaggatttttagaagaaaatctaggaatgaaaaccaagctcgaagatggtccttttgctgattttggagatagaacaagtccagaagcgaagctcgttttgacagaatctcctggtaatcgcacccgtgctgtcgaagggcttaaaaaactgaataaaattgtgataaaagtagacaatgcctctgaaattgaagctttactggcgcaagggtcacagtatagtaagctctaccaaggaaaaaatggctatggttttgaagctctttcgccagaaggagacacctttcttttacacgcagaagcatctgttgatgacctaaaagcaatccttccacctgttccatttaaggtgcaggatgacttttctggtctgaccgcttttacagtagagtctgtctggattaataccccacaagctagtattagtcaagactattatgaggctatcctacctcaacaagcctttttgcgttttgttggagcagaaggtaaggatttattaactcctgcagaacaagtttgggatttagaaggcttgcgttttcccgtcgagcaagactttgattgggcgcatttggaaagccggttggaaagaccattctttaaagataaaaaagcgagctttatccaaacagttgacccaagtggtattgaattgtggttcgaaaaatgagacaagtaattttagacaaggtttcagagcagattgagcaaggagtatatcctggtgtcagtctggctttttttctgatggtcagtggcaggagtactatctagggacccaggatgggcatacgccagttgaggcgggtttgacctatgatttggcgtctgtttctaaggtggttggagtagggactcttgcgacttttttggttaatagcggagctttggagctagataggaccttgcagtcttattatccagcttttgcggatagtgaggtcaccattcggcaattattgacccatactagtggtattgatccctttattccaaatagggatagtctggatgccgaccagctcaaggaagcgattttgaagattgctgtaacggataagaaagctttcctctacacggatattaattttctcttactgggctttttgttggaggaattgggtagagacagtctagaccagctgattagtcgagacgttctagagccctttggtatgttccgaacctcctttggaccagtcagtcaggcggtgccgacggttcgtggcgtcaaagcaggtgtggtgcatgatcccaaggcgcgtgtcttgggcctccacgcgggaagtgcaggtctcttttcgaccgtcaaagatttggaaatctttttggagcgctatctaactgaggattttgcggcgaatttaacgcaggattacggttttgatgataaacgcaagcggtctctggcttgggataagaagggggactggttgtcgcacacaggctatacggggacctttatcatgtataaccgtcccttgcagaaagctgcgatttttctctcgaatcgtacttttgacaaggatgagcgcgcccagtggaagttggatagaaaccaggttatggccttgattcgtcaggtcttggaggaagaagaggctattgactaatactcttcgaaaatcaaaattatccattgtcaacttgccttaatgaactccagttctatcttcgacttcgtttcttaggctacttttgattttcattgagtatatatcagtcatttagtttttcttttattacttcgacgatcgaggaaacatcgtttccttatttccaacttcaaacactccactggagtatttgaactcgctttgccgtactctgcaggggggacttgctccgcaagtgctatctccaaccttgcacagtcactcgactgtacaagctgtccgcagctcgttgcctagtactaaaagtaaactaaaagactataactatccttccgcaacactcagtagatttttcgacatagtaaaaggacctgcatgtgcaagtccttttgtgtctgcttgattaagcttgacctgaaacttcagcagcgtggtcgtccattgaaagaacttcgtggaagacacgttgagtcaattcagttttttgctctttagtgaggtatttagtgtttacgcagtatccagagatacgaacgataacatcttcaccagccatgattttttcataaacgtcgttcaagtccataacgttcaagttaacgtgttgaccaccttgctcaaagtaaccatcaaggattgttaccaagttgtttacttgctcatcgaatgttttaccaagcgcttttggagaaacttgagtagtcaatgagataccgtcgttggcatgtttgaagttgagtttagaaagggtattcaagttttgcaaccaaccaccacgagctttagaagttgggttagcacctggtgggaagaattctaccttagtagtgttcacagaaccatcttcattgaggaatacaccacggtgaactggagagttacctgtttgtttagagtaagcaacgttagaagtgattgtcaagatagatactgtagcttcagcattcttgtacaatttatgtttgttcaaacgagtgaagaatgcttccatgagccatttcgcaatatcatctacacggtcatcgtcttcaccatagcgtgggaagtcaccagttacttcgtagtcgtagataaatccatcttcatcacggattggtttaacttgtgcatacttgattgctgacaatgagtcaacagtgtttgcgaaaccacagataccgaagcccatgttagcacgaaggtgagttggcaagaatgccatttgaactgcttcgtagttgtatttatctgtcatgtagtggatgatattcatggcatcaacatatgtatcagtcaaccagtcaagggcgatttcaaagttcttaaccacttggtcgtagtcaaatacttcagatgtgtttggttcaacaccgtcgaatactttgtaatctttgtgaacgtcatcgtaaccgttgttccagcttgaaagaagggctttaaggacgtttacgcgagcaccaaagtattggatgttgtggcgttggtcttcgctttctggatcaagtggagatacacagcaagagatacatgacatttcaccataaccatctttcgccattgttgtcacaccttcatattggatagaagagtgtttgtggctcattgccatacagtagcgacggaatgaatatggaagttggtctgaccaaagaactgtcaagtttggttctggagagttaccgatgttgtcaagtgtgttcaagaaacggtagtccatcttagtaacacggtgacgaccatcgttacccatacctgccatagatgttgtcaagaatgttgggtcaccagagtagatttcgtcgaaggcttttgtacgagcgaatttcactgtacgaagtttcaatacgaagtcatcaacaaattcttggatttcagcctcagtaaatgtaccacgagccaaatcacgttcagcgtagatgtcaagtacgattggcacacgaccaagagaagttgctgcaccgttgataacacgacatacagccatgaaagcaatgtttgtccattggatagcttctttagtgttcattgcaggtttgcgaacatcaacaccatagtgatcacctaagcgtacaacttgttgcaatgcttggtactgcatgttgatttcttcacgaagacggattgattcttcatcgatttcagtaatggcattccagtcagctactttttcttccatcaagtagtctgcaccgtaaagtgccaaacgagcgtacataccgatgatacgaccacgtgagtatgcatctggaagaccagaaacgtggtgtgagtggcgagcacgacggatgtcagcggtgtaggcacggaagataccgtcgtttacagttgtagcgtgttttgtatagatttcatgaaggagtgggtctggagtatagccgttttcgataagagttgtttcagccatacgaataccaccacgtggcatgaaattgagtttgaagagctcatcgttttggataccgaagatgagttcgttctctttatcgatgaaacctgctggaatatcagcgatagaagtagcacgatctacgtccattgggaagcgagtgtcttcgtagccagcttttgtttcttcgatgatttttttgatatgaagtgaacgctcagttgggcctgcgaggaagctttcatctccatcgtatggagtgtagttggcttgaacgaagtgtgttacacttgccttatcttgccaatctgtacctttaaagccttcccaggcttgggcgaaaatgtcttcagcaacattttttgttttaacttttgttgacatgagggttctccttttatgcttttgggtatcgacttgctatcgataccaacatgtcattattataccatttgaaaacactttctacaagacaaaaatacttgaaaataaatgaaaaacctttcaaggaatatgaaaaaaattgaaatatagagttggtattttcaaaataaatttctgcttgtatttgtaataaggtgataagctgtcgtttattgtattggtaagatggctggttcaacgaatctaaaggctgaaacttcctaagaaatgcggtataatatagcgagttaaacttgtaaacaggaagaggcagtcatgttaatttttcccttaatcaatgatttatctagaaaaattattcatgtagatatggatgctttttttgctgccattgaggtcagggatagccctgctttgaagggcaaacctgttatcattggggctgacccaagactatctggcggtagaggagtggtgtctacctgtaattatgaggcgcgtgcctttgggattcactcggctatgtcctcaaaagaggcttatgagcgttgtcctcaggcgattttcatttctggcaattatgaaaaatatcaggaagttgggcgacaggttcgagaaattttccatcgctatactgatttggtggagcccatgtctatcgatgaggcttacttggatgtaacagaaaataagttgggcatcagctctgcggttaagattgccaagcttatccaatacgatatttggaatgaattgcatctgacagcttccgcaggtgtttcctataataaatttttggcaaaaattgcctctgatatggaaaaaccgcacggtttgaccttgattctacctgaagatgctgttggtattctcgcctccctgcctgttgaaaaatttcacggtgtggggaagaagacggtggaacgcctgcatgagatgggggtctacacggggcaagatttgctagatgtaccagaaatggttttgatagatagatttgggcgttttggcttcgacctttatcggaaagcgagggggatttctaattcgcccgttaaagtggaccgtgttcgtaagtcaagtggaaaggaaagaacctatcgcaaacttctttatcgggaggaggatgtcctgaaagagctaatcagtctctgccaacgggtcgcagccagtttgaagcgaaatggaaaaaagggtcgaacaattgttttaaaggttcgttatggtgatttttctaccttgacgaaacgtcatagtctagaggtatatacggaccagacggaaacgattgagaaagaggttcgtcaactaattgaagaaattgggaagattgaaaaagggattcgtttgctgggtgtgaccgtgactaattttcaaacttgagttctgtttcagtctatgatagactgaaaaaaaggagaagagatgcaaatttcaagtagatttaccattgccagccatatcttggttctcttggctctggaaggagaaaaagaaaaacagaccagtactagcattgcaggcagtgtcggggttaatcctgtcattatccgaaatattttgtcccaactcaaggaggctggtctggtagaagtagcgcgtggtattggaggtgctcgcttggcacagggtccagaccagattacacttttgcatgtctatcaggctgtggagttatttggagaaaaaggtcaattattcgcttttcatgagcaaccgaatccttcctgtcaagtaggtcgcaatattcatcctctgctagatagccgtttggaaaatgctcagtcagctttggaaaatgaacttgctaagacaaggcttgctgatctcttggcggaactatagtcgttttattaggtcaacgtaaggagaaactttgtttccctatttcctacttcaaacactccactggactgttgaagtaatctgtagagtgttgccctagcactaaaagactggttagtgaatcatccttgtgatgattttttaaatttttgagttgtaacaattgactttacaatcaaaaagatttatacttacgttgtaaataaagttgttacaacaaaacaagtgaggtatcaatatgaaaattgctattattgcagcgaatggtcaagcaggtcaaactattgcaaaggaagcagtagaacgtggtcatcaggtgacggctattgtccgttctgaaaacaagagcgtagcccaagaagtaatccagaaggatgcttttgctcttaccaaagaagatttggcaggctttgatgtagtagttaatgcttttggtgcttggacaccagaaaccttgccggatcacgcccgtcttgctgagcatctagcgaccatacttgctggtagtccaactcgtcttttagtagttggtggtgcaggcagtctttatttagacgagagccagacagctatgctgaaagatacaccagatttccctgcggaatacctgccaatcgctgaggctatgggtactggtctagacctctatcgtcaggcgacagcggtcaactggacctatatcagcccagcagcagattttgatgcagaaggtcaaaaatcaggtgcctacactttggctggcgaggttttccaagtcaatgcccaaggtgaaagctatattagttatgccgactatgctgtggctttggttgacattgcggaaaaaggtggctaccagcaggaacgaatttccgtacttgcataaaaaattaaatggtctaaaagatagctccatcgaggaattatctttttattttttacttgcatatagtataataatataaataaaaagaaaaggagaaccccatgattcacttgatttgtcccaatccagccctagaccgcacgcttcttgtggaaaagattgaaaagaatattcccctgagaccgacggaagtgagggattatcctggtggaaaaagtttcaacgtagcctatgcacttcgagaaaatggagtgacagactacactatccataccattttaggtgggcagattggtcgctatattcaggagcttaatgctgatggtggaaatgccctgcgcgtggttgaaaatagccagaatactcggacatgtaatatctatgttgaaaccagtacaggcgatgtagtactattttatgaaaaaggttttgaactaacagaggatttgctcaaccaattcactcagcagattgaaaatagcctgcaagctggcgacatcctagtcttttcaggtagtctgatgaaggggatgtcggatgattatattcagcggtttattgaaaaatacccagaggttctgaccatagtggacaccagtggaccagctttacgtgcggcttatcaagctagaccggcccttatcaaaatcaataatgaagagctgaaagatatttatccagagctggatgaagaaagtcctgaagctattttaggtatcctgaaagaagtgactcctcatgagaatatcatcattaccatgggagacaaggggagtctagctaagattggtcagcgcttcttccgtattcagtctccaaagaaagaaacgcgtaatcctattgccgcaggggatttctacctgggcttgctagtcaaaggaatcagtcaaggtcaagccccagaaatctttttgaaagaagcggcagcctttgcaacagccaattgtttgaattattttccagaggttgaagcagagcagtttgaagcgattgtagatacaatagtactagaggaactgtagtattgtatccctttactcatcgtgctataatggcaaggagaaacaaggtgagatgggggatagtagtggaacagttgacggttctttaccaaaatttaaaacggcgatatggtgaatttcactggtggaatgatgaaaatcctataaaggatttggtatctatgatccttattcagcaaacaacggaagcaaatgccaagcgtgctttagaacagttggagggacggttgacaattcattcgcttttagagatgcctgtggaggatttacaagaatgcattcgcccagcaggattcttcaagcaaaaatcactctacattcggtcagtggttgagtgggccaatcagttcgatggagatttttctcgcctagatcgtgttgagacagcagtactccgaaaagagctgctgagcttgaagggggttggcaatgaaactgcggatgttattttgctctatttgtgtcgaagaagtgtttttgtggcggatcaatatgctcttcggctatttaatcgtttaggacttagccagtctcaggattatttgagtttgagacaggaatttacagagcagataaaagattggtcggtaaaagacgctcaggagcttcatgcactgattgatgaacatggcaagcagttcaggttaacaaaggggcagcttgatgaatcatggttgatgatatagtcatactcttcgaaaatcaaaatcagacgttgttgacatgatttgatgaacctcagttctatctgcatttgcatcgcctagcttgattttgattttcattgagtatcaattagtgtattttttattactgaagggcgaggaagtctcatttccttatttccgagtttaaacactccactggacagttgaagtagcctgcatatcgttgccttgtactaaaagcaaacgaaacgactataaaagagtaaaaccagcggttcagttggttgctctttttttatattaattggagttattttccaagataaaatgattatagactgctaaggatgctgctccaattgcacctcgaaatatattaaaagataagaattcaatatctaaattatttttacttggaataaattgcaattgattgtcaacaagattattaactttttctgaaaaacctggataatttaataactggctattaataaaaattttttttgaatcataaatgatcaatgtatttgcgattgaggtagttaaaaaatcaatccctgattcaattttttcaataataaaaccatctcctagtcggtatgcattgtatacaacatctaatgtaatatcttctggtttttcaaccaaagtttttatgatagaaccttgaacattctcaaataaaaatcttgcattattgattaaccaagtatcagaaatataagtttgaaggcatccacgttttccacattcacaagaaggtccgtttaaatcaactactgtatgaccaatctctccaatataaaagtttttgttttgtaaaatatgttcactatcaaaaaatgaacagaacaatccaggtccaatatgaataaataaaaactgctctggcgaactttcgggatgaaagagatatgaaccaattgccatgcaattaatattgttctctagaaaaataggaattgaaatactttgtttaattacggcaagatcaaaataaatccactttacattatttgaaataatatgtcctgattttgaatcaaagtgaccaggtacagcaataccgagagctccaaattcaagataggaaaacttatctagagtttcagttactaattggataattatttcatttatttgtttggaatcatattctgtaatttttatattgctatttgtgattaggtttccaatagtgtctgtgacggctaaatagattccattggcattaatctcgattccaatataatgtctatattgagagtttactgtaataagtcgtctactacgacctgatccaatataatctcgaacctcatcgccagtctcaataacttttttttcagctaccaggtaactaatcatattcgtaatagttgccggtgtaatttttaaagatttagaaattcttgttctagagcttttttgatgtctaaataaagtttttaatatatttccagaaatatttcgaatggtttcttctttttttcccattttagtacctcacattggaaaatagtatttttcaatgtaagaataacatattttttataaaaaatgaagtaaaaacactaaacaaataaataaatttcattttttaattaaaatttataaataaaaacttgacaattaagcgcttacatgatatctttaatttacaaaataaaattaatggaggataagaaaatgaatggattaatgcattttcttgaacataaactagctccttttggaactaaggtagggaatcaacgtcatttgaaagcagttcgtgacggttttatgatggctatgcctcttgtattagttggctcgttcttcctattgctaatcagttggccggatcaggcttctgggggattttcagtagtaggctttttagagcaaattggtttgttggggattttaaatcggttaaatcaatcaacaatggcgattatctctctcatagctacattcggtattgcatatcgattatccgaatcatatgagacagatggaccttctgcaggtgttattgctttatcatcttttattttacttgcgccaagattctcaacaatggttttcaacgaatctggtgaacaaattaatcaagtatttgctggagcaattccatttggaagtttgaacgcaagtgcattatttgttgctattgctgttggattagtttcagctgaaatttatcgtttctttatccaaagaggtattacaattaaaatgccaaaaaatgtcccagacgttgtgggtaagtcatttgccgcattgcttccagcattaacaacattaattttctgggcttgcgtcttccagggattagaagctgctggtgttgaaggtggacttggagcggttttgggattaattgtaggtaaaccacttggtcttattgcaggaagtctcggtggaatggtgcttgttgtgcttgtaaattcacttttctggtttactggtgttaatggtggacaagtgttaaatgcttttgtcgatccggtttggttacagtttacagaagcaaatcaacttgcagccgccgcgggagaaaaattaccacatattattactttgcctttcaaagatttgttcgtatttatgggcggtggtggcgctactgtaggattagcgctttgcttacttgtctttagtaaaagtcgtacatttaagagtttaggacgaatctcctttattccttctctctttaatattaatacagccattctgtttagttttccaactgttttgaatcctattatgatgattccgttcattctaacaccgacagttaatgcaataattacctattttgctatggcaactggattagttccgatgactactggggttgttctcccttggacgatgcctccaattcttggggggttccttgctactggcggcagtattcagggagcaattttacaaattattttaataggtgtctcattcattatttattatccatttttcaaagtggccgataataagaatttagagcttgaagaatcaggagagtgatcatatgaaattgacgatttttgataaagtacagaataagacttctcaatttgctatagatgaacttacatattacttgaaagccatttttgattttgagttaggaaagacaactgttgaggaagatgcgaatgttcttttgtcaaaagaatatcttgacaataatgatacgattgggattgaaatgaaaaatggaaatgcaatattaacaggtaattctgatgtctcaatccttattgcggtatatcgtttacttagtgaatttggagctgtattcactagaccgggtagaaaacatgaattaatcccctcattaacgataactgactggaatgagaaagagctttctattcatgagactgcaagttataagcatcgaggagtatgtatagaaggtgcagatagttaccagaatacaaaagaatttttggattggttacccaaaattaatatgaatagcttttttattcagtttgagaatccttattcatttttaaagcgctggtatgaacatgaatttaatccgtatgcggataaagaagatttcaatacggaaattgcacaacaaatgagcgaccttttagatgaagaattatcaaaacgaggtttaatacatcatcgtgttggccatggttggactggtgaagtacttggatattcatctaagtacggatgggaatctgggttaaaactacctgaagaaaagaaaccgctagtcgccgaattaaatggaaaacgtgagttattcaacacagcgccaatactaactagtctatgtttctccaatccagatgttggtgaaagaatgtgtgaactgattgtaaattatgctaaggaaaggaaagatgtagactatttacatgtttggttatccgatgcacggaacaatatttgtgaatgtgaaaaatgtaaacaagaaataccctcagatcaatatgtacgaatattaaatcaattagatcggaaattaagtgaagaggggcttaatacaaagatttgttttttactttatcatgaattactttttgcaccaaaacatgaagttttagagaatcctgaacggttcactatgatgtttgcaccaattaccagaactttcgaaatgagttatgcagatgtagactatgaaaacgatgttccgcttccaaatgagtattcaagaaataatattgttcttcctaactcacttgaagaaaatctctcatatttatttagttggcaaaaagtgtttaatggagatagttttgtatatgattacccacttggtcgggcacattatggtgatttaggatatatgaagatcagtaaagtaatctttagagatgtcgtatatcttaaaaaattgggtttaaatggttatattagttgccaggagctacgcgctggtttccctcataactttcccaactttgtgatgggtcaaatgttgtggaacagaaatttagagtacgatgaattgaaagcgctctattttagttccttatatggttctgaatggaaaagtgtcgtaacttacttagaaaaattatcagattactcttcatgtgattattttaattcaataggtgatcgccaaaatgcagaattatcaatgaaatacaatatctcaagtaaattagcatttaattttattaataccttggaagagaatgttgctaaaaataacggaattcaacgtgatgcttggcgacaattaggttatcaccgggaatatgttgtcaaattggctaatgcccttcatcttatggcctctggagaccatcttgatggacaaatccgctggaaagattttttggattatattagaaaccatgaacctgattttcaacagtatcttgatgtctatcgtattattgaagttgctaagaattatgctggattcaaattgtagtactgagttgtagaaaaaagccaattcacaatttattttgcgaattggcttgaagtctaatatagatagaatattgaatttatttgatgttaattgatatttatttttgagaggattttatgaataaaaaaatttttttaaaatcagcgattattttgctctctgtcacatgtctaattaatgcgattaaagctttagatagtagtggtgtgtcatcgagtacaggtgaaatagtaaatcaagatcgcatatacaacataactttgaaagtgaaaacagatggggtttataatgatctgggggggaatgttatttcggaaaataatgtattgtcaggaattagtggtacaaaaataaatttgaaggttagtacaaattcaggatatcgttttgtagggtatcagtcatttttagaaagtggaaatagtacagatgggttactaccaatcgaaaatgatagttttgaaatctcggataaaacgggtaatgtaacggttgttgcgatgtttgagaagattcctattgatgagacaatttatttttcggatgaattctcaactgaaaatattaataattacttgttatctgaaaatctaattggaaaaattgcggtaagtaatggaaaattgaacattcatgctcccggggtatcatcgataaaaccaattctttcaagacagattgatgaaagttcaacattggggtatgaaattcaattttccatacaacaaattggtgaagtaaagcagtggaatacttttagagtagtatttaaagaaaatagcgatggatcagtttatgctctagaatttactggaaaagctgtatctataaaaaaactttcaagtattgatgcacctaatcaaactggtgaaaaatacgctgaaacaggccacaatctaggaagtgaagaacacagaataagacttgtagtaagaggggatacagtaactgttagtgataatgaaattccgttattaagttatagcagtcctgaaaattgggaaggtgcaacagcatccattgtttttacaccgatttcaaatagaagtgtatctttagacgatatcattattcgacaaacacgtgctttaagatctttactagttgtgtctcgtatagatggtcaggaagttacagatattcaacccggatcaatcagagggaatacaagtcaagtttttgttggagattcacttcctctggaggtcattgaaaaacctggatatcaatttattggttttaaagatgaatttggaaatgtggtcgatttatctactttcagtgttcctaatgatgagtcggatttggttatttatgcagactttcagacagctgaagtagtgaatcgtgagacaaagactttttatattgatagtatagaaggaaatgatactaatagtggagaaagtgagactaatgcatggaaaacactcgaacaattgcggaaaaacacactaattgctggtgatagagtgctattaaaacgtggaagtcgttttgttggagaagatgcggcattaacttttaaaggttcaggtcttgaagatgcgcctatcctaatttcatcttatggtgagggagagctgcctttgcttgaagcacagggcaaaattgaaagtgtaattaagttatataatcaagaatatattacaattgaaaatctagagattacaaacttagatccgaacttttcaacgagttttgaattaaattcaaataataaccgttcaaaaatactaagaggtgttcatgttatagctgaagattatggggtagttcatgatatcgttcttcgaaatatgtatctacatgatattaatggtaatttgaattcaaaatggaatggaggtattttctttgatgtttatggaacaacagttccaaccaaatatgatggcatacttattgaaaataattatttagaaagagttgataggtcagggattaaattggtcgggtccacatgggcaaaccaaaatctaaaaaacaacaaaaacattccattaaattggtatccatcaacaaacgtagttgttcgtggcaatcgtatcgaaaaggctggtggtgattctataacagttagagatacagatggtgctttaattgaatacaatatctcggctgatgccagataccaagatacaggttataacgctggaatttggccatttcaagcttcaaatactgttattcaatataatgaatcatttagaacccatggtgttcaggatgggcaaggtttagatctagaccatgtttcaaataattcagtaatgcaatataattacagtcatgataatgaaggtggtttcatgttgattatgaattggtacgagcaaacatctccaacagtccgttataatattagtcagaatgataaagataaaattttggaattggctagagggggagcccaaggaactgctatatataataataccatcttctccgactcgaaattaacagggagagctggcgttattgatatgccgagtacctcaggaggaactggtgtaaaagatatctttttatttaacaatattttttactttactgatggcgaaaaaatgtttgtagaagcaagcgatgctggtaaatataaagatagtattcatttttataacaatgcatatgtcggagttgaagtgccagatgatcccaaagcgataactgaaggtataactttaaaaggtgttggaactggaccgactgaaaataaatcgatgattgcaaatgctgggaaatttttaacaggacaattagatgggtatagattgcctgaaaatagttcgttagctaagcttggtgtgagcaaagaggaagcaatttcttatttctataaaaaactaggtgtgcagcccacaattgatttccaagataatggctccttaactatgtctccgacagaagcttttgccttggctcgtcaaacaaacagtgttgacgcgattgcacgtgtttatcctgcaatagaaggggttacttatgatactgatttctttggagaaactttgtcgagtgaaaatttatctgttggtgcagctcaagagaaaaaatcagtttttgaagaaaaaatctctgatatagaaatttcagatgtgaaaacagggattggaatgagatataaacgttcaaatcagcttgcagatgtaaatttaagtataagattgataaataaagatgaacttcaatatactataaatgctaataatccaactttttcatatgaaattcaacttcaaaaaaattttggagagtatatggatttaagtgagagtgtgacaatcaccattccaattgaggcggataaaaagattcttaatgttttgaaaattaataaaaatgaacaaactgaatcagtgaaagaactgccatatcgaattgaaaataataaaataatattagaaaccgatgagcttggttcatttatcattgaataccagatggaaaaaattaaaaaagaaaataacacaaatgcaacaataagtgaaagtggaaaaagtagtttagggttgcaaaataaagaaaattcagatgtgcaagctgtaggcgataaagattatttttctggtcttgaactatcaaataaaggtgaagagttaagtcgtgaagattctaaactaatggggaattcaattaataatttacaaacaataaaagagtctgaaagtattttcgaaggaaatttgggtaggaataaagagttgagtgacatgtatcaaaagtcattgccaaaaacaggagaaagtaaccaagcatatattgttttgattggtttatttagcctcttcgtagtcctaatttgtcaaatttttaaaaaatcaatagattaagggatttaggataacaaaatgacgaaaaaaataatatttatcttgttattcttcgtagtttgtgtttatttctactcctttattcccctcgttcagactgttccatctgtttttcagacaccttatagaacattagttcaatctgagtttgaagcgatatataaatataatggtattgaaatttcggaaaggaatttttggaataaaccgataaatggtcgtaaaccacaagatactctgaatgaaaaagcaacgatattatttaaaaaatataatcttttagaaaaagaagcgaaaaaacatgaatataaaaaagaggctcttgatttcaataaagttgattggaagacagtctcaaatcgctatattgaattaaaacaaattgttattgatgaaaaaattaaagatataaatcaagatgagattgaacgatattacttagcaaatactgaaaattttgaacgtcaagattttataagcggtaacatttctatatggaatgatgggataattatttctactgaatcagtagatattaccgaggaaacagtaagaaatataactgaaagataccctgatttagaattagaattaaagaatattgaagttggtcatcaagtttcttggggacagaatggggtttattatacctttacatgtttgtcgagagaagaaaagggaattattccactttctgaaatcacggatgcggttgctatgcaatgtgcagaggaacttgttgataattggttaaataaagaaattgactctttaaaataatccttgattattgacaatctagagttaacaaaaattttttgttaatttaaaaggaattgggaattgtcgtactgaaaaactgatttcaattattaagttaagtttcttagttaaatactgtaatttttgtagccatactaatatatattttgtaaaatagagttacataaatttattaagacgaaacattttttatgtatttgtaactatgggaggatgaagatgaagagcaacaaagaacaaaaatatttttggttgacattctcattgattgttgcattgatgatttggtggtttttatcgaattatgatcgaacctctcgtagttttccaaatatcattttggtttggaatgctttattaatcatgatagacaaaggatttatctttgaagatatattttcaagtctaacttcagttttcttcgggttcacgtcgggctttctattgtcggcgcctaatgcactcttaatggcctggtattcaccttatcgtaatattgtgaaaccttggatacaatttatcagaaatattccacctcttgcatacgtccctttagttgtaatttcagctggggttgggctattacctcaagttattgtaatagcgatagctacttttctgactatgactgtaacaatttatcaaggcattattaatatcgatccaaatttaattaaagcagcaaggattttaggagcatcagattttgaaatatttaaaagaattttggttccctcatctattccatttattatgacagctgtcagattaggtacatcgatttctttaacaactatcatagcagctgaatctactggtgcaacatcaggtatgggaatgagaatacggtccttaaataactcttttgattcctcgggaatgcttttgtatatcatattgattggagtgattggtttacttttaaataagttagttgatttgatagaaaggaagttaactggatggcaacagaagtaaaaaaaattaaggtcaaaattgaagatgtttcaaaatcatttcagacaaatcatggtgaggttgttgcactaaatcaaataaatttagaaatctttgagaatgaaatagttacagttgttggtccatctggttgtggtaaatctactctactaaacttggttgcaggtttggaacctgtaacttccggaaaaatttattgtgatgataatgaaattgttggcattggagttgagcgtggagttgtttttcaacaatatgcattatttccttggatgagtgtactacagaatgtaatgttcggacctgaaatgcaaggaaaatcaaagttagaagctagtgaaatagctaacaagtatattaaaatggttggattacaagaattttccaatcattatccgaaagaattatcgggtggaatgaagcaaagggttgctatagcgagagcttatgctgttaacccgtcaattctattaatggatgagccctttggagcattagatgcactaactagaattcagcttcaagaggagttgattgaaatgttaggacaagaacaaaaaacttgttttttcataacacatgatattgaagaggcggtactattaggaaatcgagtgattgttatgagtccacgccctggagaaattaaagaaattgtgaacgttgatttaccattttcaagaaatcagttgacaaagtttgaaaaaaattttatggacataaagaaccatatatggtcacttgtttataaagattttctaatataaaaaagtgaaacagtagaattattttgtgagagggtaaaatggctaaatatatgaaatataaaaacttcatttggtttatttgcagcataatcactctgatttttctttcttcgtgtagttctattcaaacctcctctagtggccattcagcaaaagttgacacaattagaattgcatatatgccaaattttgcaagtcttcatgacattataactggaataaattcaggtatctttaaagaggaggggcttgaagtcgaattgattgaatttgctgatggtccgactatcattgcatctttagagtcaggttcaattgatattggtaatattggtccgggtgcccataaattggcgattgaaggtagagcagaagttgttgcatttagtcaacttgggaatgctgacgaattgattgctcggtcggatagaggaattgattcaatagaggatttgagaggaaagaaaattggaacagcatctgggacatcagcagaaacaattctaaagcttgctttgttagaagcagatttgtctgaaaaggatgtagaaattattgatatggatgcctccgctattgttacagcaatgttgtcgggttcaattgatgtagctgcaacctggtcaccaaatacaacttttataaagcgagaattaaaggaaaaggtcgttgtactagctgataattcacgttatagagaacaatctccagctattgcttcatacgtaacttttccggggtattctgaaaaaaataatgaaaaaatttccaagtttttaaaagggttatatcgtgcaatggattatcgagctgaacatatgaaggaagtttcaaaatgggttgctacccaaatcggttcagatatcacagctgttcaagatcaactacaagatggagagtggttaacaagtagacaaatgattcaattgattaacactgggatacttcaacagtattacgagaaacaacaaaaaaatttaatagaatctgaaatagttgatacatccaggaacattaatgaatatgttctaattgatcaaatgaatagtatattaatggagattaaataattcttgtgaaacacaattagccattttattttcaataaaagttacattgaatcaataatcattcatagttttcaaggaaacatgaggtaatgcatgatagaatattacaattttagtaaaagtgaattagaaaaccatagtagaattccattgattataaaaaagaataatgaggaaatttttatttcacttgctctagaaatggtagaattaataaaagaaaataacaaaaaaaatgagaaaactgtcataatttgtcctgttggaccagttggtcattatccccattttgttagattagtgaatcaatttaagattgatttgtctgatgtttggtttataaacatggatgaatatttatcggaagatttacattggatagacgtagtccaccctcttagttttcgaggatttatgcagaaaactgtctacagtcaaatacatccaactcttattatgcctgaagaacaaagaatttttccagatcctcttgatattgacttgatttcaaataaaatcaaagagttaggtaaaatcgacttatgtattggtggaattggcctaaatgggcacattgcatttaatgaaccggattcaacattaacagttcaagaatttttaaaattagagtcgcgagtgttacctatctctgtcgaaacaaaggttatgaattgtttgacggaattaaaaggggctgtagaagaagtgcctaattattgtgtaacaataggaatgagcgagatttttcaagcgaaaaaaattcgacttgctgtttttcgtgattggcatcatgcggtcatacgtaaaacagtttgttctaagccagatactggatttccatcaactctaatgcaaatccatacaaattgttctatctatctaaatgaatcgttagcaaattaacggatgttcaaacacatatgaaacatatataagtctgttacccttttgatcagatacctaatgagagaggattctctcatttttttaatcaaaatcgtttacaaatgtaatcaaaaagcatgtgatttgactgcaaatgtagtcaaaaggagagcagtattatgaaaacatccatctataatgtcaatgggatgacttgcgcaacctgtgctctgacagtcgagaaagccttgaataagctagatggaatacaaaacgccagtgtgaatctagcaacggaaaaaacaaacattcagtatgatccagcccatctgagcttatcagatatcgacagctgttgaaaaagcaggttataaagcggtactgccaaaaacacaagagtcagaagctcaaccaagcggaaaagaacaacacaaaaatgatttatggcgcagatttatctggtcaaccattttcacgcttccactactctacattgcaatgggacctatgttaccaggtgggggattgccattgccagctatcttacaccagccgctagtttttgccctagttcagctcattcttgtattaccagtcctatatgttggtcgtgcattttatcaaaaagggtttaaaaccctgtttgccggtcatcccaatatggatagtttgattgccgttgggacaagtgctgccttgtttcaagggatcattatgacgattttgattgctaccaaccaagtagccacccaacatggacatcctgagctctattttgaatcggcagctgttattttaacccttatcactcttggaaaatacatggaggcattatcaaaagagcgtacttcagaagccatcagtaaactgatgaatctcgcccctaaaactgcacgcgttctctgtgaaggtcaagaagtgaccctccccttagaccaagtcaaagtaggagatgtccttcaagtccgccctggtgaacagattccagttgatgggataatagtagaaggccaatcgacaattgatgaatccatgctgacaggggaaagtttgcctgttaaaaaaacatcggggatacagtcgttggtgcgactctcaatcaacatggtgctttccaaatggaagcgacaaaagttggagcagataccacattgtcccaaattattcgtttggtggaagaagcacaggggtcaaaagctccgattgcgcagttggctgaccgcgtttcagcagtctttgttccaattgtaatgggattagccgtcctttctggccttgcttggtacttcttgggacaagagccctagatgttctcactttccattaccatctccgtccttgtcattgcctgcccgtgtgtcttgggccttgccacaccaaccgctatcatggttgggactggaaaaggggcagaaaatggtcttttgttcaagtctggtcaaactattaaaaccctacaaggtgtgaacaccattgtcttcgacaagactgggaccattactgagggcaagccacaagtgacagacatccaccttttgtctactaaaaatcgtgagcaagttctccaactggcagcaagcagtgaacaatactccgagcatccattggctcaagccctcttacgttcagcagaagaggaatcaattcccttacttgccagccaagattttcaggcactttctggtcgtggtctttcggtaacaatagcagagcagaccatctatctgggaaatgaacggttgatgcgggaacagggaattgatgtttccaaaggacgtgcagttgcggaaacatttgcccatcaagctaagacgcctgttttcctagccagccagcaagaattactagcagtcattgccattgctgataaagtaaaagagaccagccgtcaggctgtccaggctctgcaaaccatggaactagaggttgtcatgctgacaggagataatgaaaaaactgcccaggctattgccaaggaagtcggcattgagcaggtggtcagtcaggtcctgccagatgacaaggccaaccaagtcaagttcttacaagaacagggcaagacagtcgccatggtaggggatggcatcaccctgtctgattactatgaccatgcctttggaaaatcctacggtgtgctcatgcgggagtggaatttgctggcgcgtgcggtctttgtccttaatgccgacaatgagatcgtctacgtagaatacctagacaatgtcaacgaacacccagattataaagcagctttagaggctgtcaaataaaagaatataacggtgttcatctactgacttgctggtttttatgctttaaaaaattcttcaatatctgcctgttctatgccaatcatggggtcgatggttagtaggttgtctacagtcaaaatgtattctgtgggttggggacttgttttttctggctggtcttgatcaagaagggagagttgttggttgttttctttgactactttaacctgttcttttctgtctggctgagtagggggctgggtttgcgtggttgtagctgttttgctttcgtcttttttaatcaggctttccttgctttcctgctctgccatttccccttggaaacgtgggaccagataggtttttcggacggtgccggcgtttttgacggcgtagtcgaaggcggagatttcgcccaggaggatgagcttgctcttggagcgggtgatggcggtgtagaccagattgcgctggagcatacggtggctggtgcgggtgatggggaggatgactacctgaaactcgctgccttgggacttgtggatggacatggcataggccagggtaatcttgtaccattcgtttcggggataggtgacctcgctaccgtcgaagttgatggtaatttcgtcctgcttggagtcggtgtacttggcaggaaggaggtcggtgatgtagcctaaatcaccattgaagacattggcctcggcatcgttgactaaatgaatgacccggtcgccttggcggaaggcttgctcgttatgcaggaattctaactctccctcttccagtggattgagcagggcctgggtcatagtgttgagttggtcgatgcctgcggccccacggtacatgggagcgaggatctgtacctcgtttgcaggaatacctgacttgatggctgcgccgacaatgcgctcaatcagggctggaatttgttcattctgggcttcaaaataggaacggtcagcctttttctcacgaaaatcgctaggcagagcaccctgtcgaatctggctggctagggtaacaatggtcgaatcatcggattgacgatagatacgttctagagtaatgctgggcagcttgtcaattttcaagaggtcagcaagtacttgaccggggctgacagaaggcaattgctcggcatcgccgacaatcagaacttgggtctgggaggagatattctggaagagctggtttgccaaccaagtatctaccatagaaaactcatccacgatgataaagtcggcatccaaataatcatcacggtaggattcctcctgtccttctaccagaccgagatggcggtggatggtggcggaaggcagccctgtcaattcattcatccgtctggttgctcgtccagttggagcggctaggaggactgggcattcttctcggtttcgcgtcaggtcaatcttatgcaagatagcatagactgcgataatgccgttgataaccgttgtttttccagtccctggcccgcctgtcagaatgaaaagcggattggtaatggcttggacaatggcttctttttgaatgttatcgtaggtgagagaagatatgctttccagctctgctatggcagcctcgacgtctgcgcgtgggaagggcttgaagccgttttttcccatcaggcgagttaggtttgtatggataccatgttcggcaaagtagaggctgttgtcaaaaatctttgtgccttcttgctgtaccttgtcgtctgcaatcagtcccgtcaattctttggcaacagcagcggggtccagctctgtatggcgggatttttccagcagttcaagggttgcttccagcaagtctctggcctccacataggtatcgcctgtttccatggagcgatgaatgagactaaagagcatgccagcccgaaaacgttggggtgaatcactggcaattcctagattttccgcaatcctatcggcaatggtaaagccgagcccctggacatcttcgaccagttgatagggattttcttcaataatctgaagtgttttttccttatactggtcttggatttgaaaggccaatttattgggaatgccatactcggctagttttgccaagatcaactcggttccataattgaggcggagtttttcgacaaatgcctgcatgttcttgctggataggcctgtgatttgggttagtttttcaggttcagctaaaatcttatcaatggtatcttcgccatagagctcaacgattttttcagctgttttgcgtccaattcccttgaaatgctcgctggagaaatacttgaccagaccagctgaggtaggcttgctgcgttcgtaacgcgaaatttgcagctgctgaccatacttgggatgggtgaccagattgccatagaaacgatagtcttctccttcaatgacatcggcaatcgttccggtcacaataatttcgtagtcatcatagtctgcgtctgtctcctcgatttcaaggagaaggattttataaaaattactaggattttcaaaaataatccggtcaatagtaccggtaaaatacacttcgttcatagagtttatttccaataataatgaaaagggagtggggaagaactcgcatagaccaaaaagagttcccctcacttccaaatatgcaggttcgggctaaaatagtccactggactattttactcccaacccgcacagctccaacagtccagtggactgttaaacccaatcaaccactgcgctgggatgttgacacgaactctgagaagtggtgctgtgctttttgctccaaacttgtttgtattaatcaacagtcccaatacggttgagaggccacatgcgaaagacaacttctcctttgatgttttcacgggaaaatgttcctacactacgactatctagtgagacaaggcggtcatctcccatcaggtagtattgtccttctgggactgtcacggtaaagtctacgtaaccattggcatcttgtgtgaaagcttcagcagattgggccacagcttggaattgtttgttataagaatagacttcttgaagtttatctttttggaatgcagctagatattcatctaagtaaggctcgtccactttttggtcgttaacatagaggacatcgttttcgtagcgaatggtgtcacctggcataccaatcacacgtttgacaatcagtttttccttgccatcgctgtctgtttcgctggctacaacaatatcaaagcggtcgatagaggatgttttgagcatgatgagtttttcttggtgttgaagcgttgggtccatggaatggccatcgacagatacaggattccagataaagtaacgactggcaaaaaaagctgccataaacagtaaaaagatgccccattcagctaagaaggcgactagtggtgagcgttttgttttttggattgctcccatattttttcctcatttcaataatttttgtgctttttgcgtattggcaaagtggagtttggcagtttggttgagaccagccataccatattgttttaagatgcttgctgcgacttggtcggatttactgcccgcaccagacggcagatgcattccaactagttgaccaagctggacaagattttctaaaaacatacttcttgcaatgatagaagatactgccacagccagatacctgccctcagccttttcttctagagtgacggggttggcaaattggttggcttccttcttcaagtacttttgataattttgactggaagtgaaggcgtcaatgacaatcttctcaggctggacacccttttgcaagagtaggaaaatagcctgattgtgtagggcgaccttgacagacaccgcattgtagccttgctcgatgacttcgttgtattttttcggtgacaatagcagagcttggtgggggattttctcttttaagagaggggcgatttggcagattttttggtctgtcatttttttggaatcatcgacaccaagcgacttgagaaaggaatggtcttctgggcggacaaaaccagcaacgactgccaaacctccaaaataagacccgtttccaacctcatcggtaccaatcatgggcaggttttgaccaggtatggtcgcctgtccagagctttctggctcatagccccaacggcttgcttcctgctctgccatttccccctgaaaaacgacttttccagaagtgtagatggacaggcttgcaccggtcagtttgaaaaatgcttctatgtaaggatttttgctggtctgccgatagcggtcatagtgagccatcatggcttgtttttgctgggcagatgcctttagtacaacggtattcatgttcttattgtaacacaaatgctagttagagtgtgcagaaaagggtggaatttactataatggtagaagaaagtgaggtacactatggaagtgcaaatgaagtataaatgggcgactctgggaacaggtgtcattgccaacgaattggttcaggccttgcaggctatgggaggaaatctttattcggtagccaaccgtacctatgacaagggtgtggaatttgcgcaaaaatatggcatcgagaaagtttatcgagaaatcgatgaagtgtttgaggatcctgaagtagacattatctatatttctacgcctcacaatacccatatcaattatttgagaaaggccttgaaggctggaaagcatgtcctctgtgaaaagtctattacgcttaattcagaagaattagcagaagctattcaattagctgaggaaaatcaggtcgtcttggcggaggccatgaccattttccacatgccaatctatcgtcagttgagcgaagtggttgccagtggcaagcttggagagttgaagatgattcagatgaactttggcagctacaaggaatatgacatgaccaaccgctttttcaataagaacttggccggcggtgccctcttggatattggtgtctacgctctgtcctttgtccgttggtttatgatagaaaagccaaatcaagtcctatctcaggtcaaattggctccgacaggtgtggacgagcaggtagggattttgctcagcaatgatgcaggagaaatggcgaccatcgccctgaccctccatgccaaacagccaaaacggggcactattgcctacgataaaggctacatcgagctttacgagtacccacgtggtcagaaagcagtcattacctatactgaagacggtagtcaagaagtaatcgaagcgggcgagacagccaaggctctttcttatgaagtggcggatatggaaaaagctgtcgcaggcatcgaaaacaccatgcacctagcctacacccaagatgtcatggagatcatgacccaactccgtaaagaatggggcttggtttatcctgaagaaatgtaggatcttgactaatccgaaaatagaaatgagagtgagttagtagccaattgttggattactgccttactcttattttttacttatagtcttcgaaaatccagacgttgttgacttgatttgatgaagttttgttctatctgcatctgcgtttccgagtctgtttttgattttcattgagtattacctaataatatgacagtcagatgacatttatattgattgtgtgacagaaaagtcctaagattacatagtggagacagtttatttaaaagaacggttgaaggcttgtttttcagatttaatttaggtaagatagaaccatctcaaaaataatgaaggaataagattatgaaacgtaagagaacaaataaaccacaacatatgcgtcgcaagagaaaaacatccatcatgaaaaacaataagaagatgttatacacatcttcattggctctttccctctttagtacggggatgatttcgacaaatgttttagctatcgaatgggctccacgtactgtttctgaaattagcccagaaattgtacaagaagaaggaatgatgacctatactgttcagtatggagataccttatctgccatcgcctcagctatgaatattgatatggacttgctggcgaaaataaatcaaattgcagatatcaacttgattttccctgatacggtactgacgacgactgttgaccaaaacaatcaagtgactcaggttgagattgaagctcctgttcagggaaacacaaatgagaccgttcaggcaactgttgacctaacaaccaatcaagtaacggttgaggatacggttgttcccttggatcaaatttcatcagttaccgactcagcgcctgtagaggaagttgtagaacagcctgtagcagaagcacctgtggttgaggcacctgtagaggaagttgtagagcagcctgtagttgaggcacctgtagaggaagttgtagaacagcctgtagttgaaactccacaagtgacagccctatcaaccactacaacaagtacaagtgcttatgatgtcggtttgcaacctcaggtagcagccttccgcgcagaagtagctaatgccttcggtattacttctttctcaggttaccgtcctggtgattctggcgaccatggtaagggattggcaattgactttatggtgcctgagagctcagctctaggagatcaagtggcggcttatgcagttgcaaacttagcttctaaaaatatcaactacatcatttggaaacagcgcttctatgcgccgtatgacagtatctatggtccagcctatacatggaacctgatgccagaccgtggtagcattacagaaaaccactacgatcatgtgcatgtatcttttaattagacttacaaaaataaccgtttcagccttatctgaaacggttattgctttatatgtagtaatatagtcgaatgaattaactttcagacaaggaactgaggtgcaggtagctagaacagcctagaggctgttctaggttggaaataagacttgcgaaacaagtcactttcgtagagtacggcaagccgaaagtgacgatgtatcaaagttaattcaaatgactataaaagaagaaacaactatctccccccagatagctgtttcgtgcgcaaattacagtctaaaatatattcctaaaagaaaccttaaaccaagaacttgccttcacaagtaacctactgagctgtgaaggcgggttctaattttaggaaaattaaaattgacatgtagagtgttattttcggatgttttatcgtttatttaacttgaatcgccaatgcttggtaaggtttgagaatgatttttttgcctagtttgttgtcaggatagttgctgatgaggacttggccgtgggcatagtcgtctgccaggtctaattcgacctcttctgcaaagaaattgttgaggaccaacagtttttcgtcatttagcaagcgttcaaaggcgtagactttctggctatccttgtaggctgccttgtagtccccttctgaaatcagagggagttctttccgcaggcggatgagttcttggtagaaggtaaagattgggcctgttttttcctgttcaacgttaatcgtttggtaggatttgccagctttcaaccaaggagtgcctgttgagaagcctgcattgtcagaagcgtcccattgcatcggggtgcgggaattgtcacgggacttggcctggataatcttgaaggcctgcttaggcgtgtgaccttggtccaagagcatctggtaggcattgatagactccacgtccacgtagtcgtccatgctatcgtagtcagggtcgatcataccgatctcctcacccatgtagatgtaaggtgtgccgcgtgataggtggatagaggctgccaacatggttgctccttccttgcggaaattctccacatcaacaaagcggtttagggcacgaggttggtcgtggttgttgtagaaaagggcgttccagccatttccgacggacatttcttcaccccaagtgtggaagaggtgtttgagttcttcaaagtcaaagtccatgatggtccatttttgcccgtccttgtaatccactttcaagtggtggaagttgaaggccatggacaattctttccgttcaggagctgtgtagaggatacagttttcaatggtggtggcagacatttccccaacggtcatgaagcccttttcactaccaaaagtagcattgttcatcatcttgaggtaatcgtgggtaatcgggcggtcggtgtaagctggcttgccgtcattaattgggcaatcttctaggacttcgtccttaccaatcaggttaataacgtcgaagcggaagcctttgacacccttgtctttccagaagttgaccaccttgaagagttcttcacggatatgaggatttcgccagttgaggtcggcttgggtcacgtcaaagaggtggaggtagtatttcccagtatctccaaaaggagcccaggcattgccaccaaacttggacacccagtcagttggctggtcacgcaggataaagaaatcttggtaatatttgtcgccggcaagggctttttggaaccattcgtggtcggttgagcagtgattgaggaccatgtctagcatgaattcgatgcctagttctttgccgacagtcaccatttcttcaaagtcagccatggtgccaaaatcaggattgacagctgtataatcagaaatatcatagccgttgtcccgctgaggacttgggtagaagggattgagccaaatcatatcaatacctagctcttttaaatatgggagtttttcaataattcctcgtaaatcccctacaccatttccagttgtatccttgtaagattttgggtagatttgataaacaacctttcgtttgtctattgtcattttgctctctctttcttgatttttccttcttgcataagcaatgataggaggtgcaagttaccttgcgccctcctagaacattaattctttgtaactgtcagaatagcttcgccttgtgagatggcacgaggaagatttccgataacttgagtgtcaaagtcagtttggttggtcacgataactggtgtttcagcgatgagaccagcagccttgatgacatcgatgtcaaagctaatcaatttatcaccagcttttaccttgtcgccttgtttgacgtgagctgtgaagcctttgccttccaatccaacagtatccataccaatgtgcataaggagctcaactccgtttgtagcagtgataccaacagcatggttagttgggaagaggacagatacttcaccatcgactggagcaaccaagataccttcgctcgggtcaataaggacaccttggcccatgacacctgatgcaaatacaggatcagtagcttgtgacaattctttggtttgaccagtaagtgggctaatcaattcgatagcagcgccagtttcaacaactgcttcagttggagctacaacttcttcaacagtttcttctttttttgaaaatgcacctgtacgtttgaaaacagctgtcaaaatcattgggacaacaatcgcaacaaccattgtcataaagaatgcaccccagtattcagccttgatagacaagatacctggaagaccaccgataccgatagaagctgcttggatgttgaaggttacagagagtaagcctgcgatacttgaaccaatcatagcagctacaaatgggtaaatgtattttacgttgacaccaaagagggctggttcagtaacaccaaggtaagcagaaattgttgcaggaagagaaacttgtgcctctttttcatttttacggttcatgaggaagtaagcaaatactgcagaaccttgtgcaatgttagaaagggcgatcattggccagagaccagtaccaccagcatccgcaatcaattgggtatcgatggcgttggtcatgtggtgaagaccagtgataacgaatggcgcataaagggcaccgaatacagcaccgaagagccatttcaatgggccagtcaaaccagctaatacaactgttgacaaccattgcccgattgtccaaccgataggaccaaggacagtgtgagccaagatgattgcaggaagaagtgataggaatggtacgaagatcattgagaccacttctggaacaaccttacgccagaagatttctaggtaagacagtgccaaaccggcaaggagggcagggataacttgcgcttgataaccgatacgggcaatactaaatgcaccgaagttccaagaccagtcgctggcaatggttgctgcatctgtaccaggtacagcataagcgttgagcaactgaggagaaaccaaacagataccaaggacgataccaaggatttgtgaagttcccattttacgagatacggaccaagtgatacctactggcaagaagtggaagatggcttcacctggcaaccagaggaagtgattgacaccattccagaaaggagaaacctgaacgatggtgttccatacagggttaccatcagcatcgaagaccaactgcccatctttcatagcttgtccaagccattccatctgaacaccttccaagacgttacggaaaccgagaatcaaaccgccgacgataagggcaggaatgatcggtgtgaagatttccgccagcatggtcatgacacgttggatggcattttggttacttttagcggctgactttgcagcttcttttgatacgccttcgataccagacacagctgtaaagtcattgtagaagattggtacatcgttaccgatgatgacttggaattgaccagcgttggtaaatgttccttttactgctggaatgtcttcgatgacttttacgtttgcttttttctcatctgcaagaacaaagcgcatgcgcgttgcacagtgtgttactgcattgacattctcttttccgccaatagcttctaggagctgtttggcttctttttcaaattttcccatatatttttccttctagacggcttatggaatccgtcaccctatattttttagacatctctcgaagcatgtccttttttgaaatttgtacggacaaatttcttttgtgttatcattgtatccgatttcaaaaaataatgcaagcgtttttgcttagttttttttaattttgaaatgaattttgttataatgttgatagttgtatgttatttgacagatgaatttgcgaggaaatgatgaaaaaataccaagaaatttataatgacttaaaagaaaaaatacggacaaatgtttatccggcagaaagctccctaccgacagaacagcagcttcaggaaatctatggtgttagtcgtgatacggttcgtaaggcgttggcgattttgactgagggaggtttgattcaaaaagtgcaagggcgtggttcaatggtccttaagcaagaaattctcaatttcccagtttcaggtttaacttcctatcaggaattgacaaatgttctccagctttctaccaagacagatgttgtcagcttagatatgattaccgttaatagtagcctttcgcacttgacaggctttgagccgtatagcaaggtgtggaaagttgtccgtacacgttcgattgacggtaaggtctccgttgtggatacagattatcttgctgtcgatgtcgtgccagagttgacaactgctattgctgaaaaatccatctacgaatacctagaaaataagttaggccttgatattgcttatgcacaaaaagagattacggtagagccgaccaatcgagaagagcgtgagctaatgcaatcgaaggatgattatttggtcttgattaaatctcgtgtctatctcggtgatacccaacaattccaatatacagaaagcaagcataaaattgataaattccgctttgtagattttgctcgtagaaagcattctttataggagagattagccaaatcaagttttttacgctataatagatagaagaagaggtaagatatggcaaacttaaatcgatataaatttacatttggcgagaagcaattaactttgacaactgagcatgataatttattcatggaagagattgagcgtattgcacaggaaaaataccaagccatcaaagaaaagatgccgacggcggaccctgaaaccctcgcgcttttgttggcaatcaatgctctatccgttcaactaacgcgcgagatggcatttgaacaaaaggaacaagaacttgcaagcgtcaaagaaaaggttttgaaaaagaatgtgaccttgattgacttagatgagcttgaggacaaggtatgatttcattagcaattattctcattttggcatggagtttctacattggctacagtcgtggtctagttctacaggccttctatagcatgggaagtattattgccctggtggttgcgacggctacttataaaaaattggcatccttcctttatctctgggtgccatttgccaatgctactcaggggagctccaactactattttgatgagaaatatctctttgacctagatatggtattttatgcgggattggcctttcttttgatatacgtcttggtttacgctattgtgcgtttcataggaatatttgtccatctattagaggcttttaatcctgatacaaaaacgaccaatctcataagcggcgccttggctgtcttggtgacttttatttctcttcagattgtcatggtcttgctatcaactattccgttagcgatgattcaagataaattgcacagtagttttcttgccaacatcatgattcagtacacaccattcactagtagctttttaaaatctctctggttgagtaatatagcagggtaagggaggccttatcctttttatcgtcatttataatactcttcgaaaatcaaaaccagacgttgttgatttgatgagtgggaaagactatatttttatcttttattgttttgataatgagataaagctaaggaaaagactaagtaggaatatatgaataataaaattattgaaacccttgaatttcacaaggtaagacaaaaaattgagccctatctcttgacggaacagggctttgaagaattacgacagttggagcccatggtggaagtccatcgtatccaacaggccttcgacgagttgacagacatagcgcagatttttgtggaaaatccctatttcagtctggctgctactagtgacatcggtccagccatgcgtcgtttggaattggatacagacctcaatatcgctgaattattagctgttaaaaaggtcttggaagtttctaaatctctcttggatttttatggaaatctggaaaatgtcagtcttagccagcagttggataaactctttgagaagattgagctttttccacatttacagggctccctccagtccatcaatgatgctggttttgtagaggattttgcctcagaaaagctggctcgtattcgaagaaaaatccgtgaagctgaagatcaagttcgtcaggtcatgcaggatattttgaagaccaagggcgacatgctgtccgatagcattttggcaagccgtaatggacgcaatgtccttcctgttaaaaatacctatcgcaataagattgcaggggttgtccatgacatttcagcttcgggttcgaccgtttatattgagccgcgggcagtggtgaccttgaacgaagaaatcagtcacctacgtgcagaagaacgccatgagctcaaccgtatcttgcaggaattgtcggatatgctccgtccgcatggtggcgtgattcgtaacaatgcctggcttatcggacatattgatttcgtccgtgctaagcatctctttgcgcgtgatcatcaagcagttgtacccaaactatctgagaagcaggatattgcccttctcaacgttcggcatccgctcattgctaagcctgtaccaaatgacctttatttcggtagtcagttgacggctatcgtgataacaggtcccaacacaggtggtaagaccatcatgcttaagaccttgggattgacccatctgatggcccagtctggtttgcctatcttggctgataagggcagtcgggtagctatcttcaaagaaatttttgcggatattggggatgaacagtcgattgagcagagtttatcaaccttctccagtcacatgacccacacggtggaaattttaagagcagctgatcaagattctctcattctctttgacgagttgggagctgggacagatccgcaggagggtgcgtctttggctatggctattttggatgaccttcgtctgcgggggatcaagaccatggcgaccacccactaccctgagcttaaggcctacgggatagaaacctctggtattgaaaatgccagcatggagtttgatagcaatagcctgcgtccgacctataagtttatgcagggtgttcctggtcgctccaatgcctttgaaattgcccgccgtcttggtctatctgatattattatccagtcagcccaatcttggacggatacagatagcgatgtgaaccgcattatcgagaaattggaaagtcagacggttgaaagtcgtcaacgtctggataagattcgtgatgtggagcaagaaaattacaagatgaaccgagccctccgcaagctctatgacgagctcaatcgtgagcgggaaaatgagctcaacaaggcacgcttggaagccaaggaaattgtagatatggcattggcagaaagcgaggatattctcaaaaatctccatgctgcagctagtcttaagccccatcagattatcgaagccaaggcagagctgaaaaagttggcgcctgaagtggtggatctgtctaaaaacaaggttctgaagaaagctaaaattaagagggaagccaaggtgggcgatgacattatcgttacagcttatggacaacgcgggaccttgaccaatcagctcaaggacgggcgttgggaagctcaggttggcttgattaagatgaccttggctaaagatgagtttgagttagtcaaggcggaaaaggcagagcagcctaagaaacgccaggttcacacagtcaaacgtgccaatgtacgaggaccaaaagcccgcttagatctccgtggcaaacgttacgaagaggctatgatggagctggatgaatttatcgaccaggcccttctcaataacctagcccaagtcgatattgtccacggtattggtactggagtcatccgagaaggggtgaccaagtacctacgccgcaacaagcagatcaaggagttcggctatgccccacaaaatgcaggtggatcaggctgtactattgtgacgtttaaatagcaatcaaccgatgggagattcttatgattatcagaaaatatcaaaccagtgatgaaaaaggctgggtttactgtaaggcactcagctacctcttctctccattctttgatgatagagaaacagagaagcccgaactaatgacagacgtttatgatcatcgtgtggaatgggtggctgaagtagatggacaaattgttggtctaatcgacatcgatatttacactgaggagtgcagccagtcttatatttacgcaccaagtaagcgaacagcttattttactaacctagcagtccaccctgattttcaagggcagggcattgcccaggcgctttttgaaaaagcagagcaggagttgagagcgcaaggtgtagagaaactagccatctttactcgtgaggatgatgcagccaaccatttatatcagaaatggggtggtgaggtagtctgttcggattatctagtggtcggagcgccacaagatgttccaaccttccgctttggaattgatttagagcgaggtagattgtccttttcagatatggaaggtcagccagttccctactatttgagagaaggtgtttatgtagtcagcgaagaagctggcttggatctctttgacatagaagatgtctatcaagaattaacctatgtggtggatttaacagaaaaaagttgaaacattttcaacttttttctttttgtaaatgaatctggtacgtgattcccccctcgtcctcctgcggtctagtttagctatacctattttttacaactgaaattcttataggtacgtttatctcatgcttcatcccgtagcaaaaattcgctttctgtttttttttggtgtagaatgatagtagaaaaacagaaacggagaaaattatggttcaagttattacagatgcaaactttgaagttgaaacacaagaaggcgtagtccttgttgacttttgggcaccatggtgtggtccttgtcgtatgcaagcaccaattttggagcaattggcagatgaagtggacgaagatggattgcgtatttacaagatggatgttgatgagaatccaaacacagctcgtcagtttggtatcatgtctatcccaactcttttgttcaaaaaagatggacaggttgtgaaacaagttgctggtgtccacacgaaagatcaaatcaaagctatcttggcagagattggttaattgaaaatgaaagcaagtggtggatcgactacttgctttttttataatcagacttacttttgtgattattttctaatatagtcttttagtatttgctccaactatctgggagatagtgggaggttggaaatatagaaacgatatttcctagctcgtcgaagtaataaaagaaaaactaaatgacgatatttgctaagatataagattgtgaaggttggcacaagatgttataataaccttatcattgtcattttagaaaggttagatatgtcaactattagttacaaaccattaaatctctatcgtcagtttaaaacagcggctcaagagtttccaaatgttgccatttattttgacaaaccctacgcatctttccctgaattaggattggaaaatacctatcaaacagtttttgaagctattcaaaaaagagctgcccaatttgcagcagcaggtattggctatggggacaaggtaattctatataagagtccagcctttgatacctatttgttagcagtagcggtaacggcattgggtgctgttcctgttatgatttcctaccatttgccatcttcgaatttagatgtgtttgcggagcgattggaaaagtctttcattgtctacgaccaagaaacagaagaacgtgtagcaggaatgactcgaactgacctggtcacaaagatatttttaccccaagtcctagtgcaagaagcagttgcttttgaagaaaatctcctgccagaagatgtcattcaatacatgactcatacttcagggacgacaggtgttccaaaactaatctgccatacagcacagaccatgggctggcgagtagcttggcaacaaactatttttgacaagatgacggagagaggcttgctggccttccatatctcccctgtacattcacgctataatatcggcgtgtcgtcggcgattgggttaggattccccctctacccactttcttctgcaagaaaagatgatgttgaacgggcacttgctcttcatcgtccaagtgctctggaaacccatcctaataactttgtccaatgggcaagattggccaaggaaaaaccagaggtctttagtagcattcgttattaccattcaacctttgatgctatcaatattggtacgcttcgcgccttcttggaggcttctaaagagcaagatccagtctttatgcaggtttatggtcaaagtgaatgtggtccaatgattttacgttaccatcgcttggaaaacctaggaacagttagcggacgagatatggggattggtctggaaggttacacagaagcacgtatcacagatgcccaagggaatcctctcccagctggagaaaacgggcatatccagttcctgtcaaaaggccgtgctgtgacttactacaaagaagatgcccgcttccaagataatgtgtacggtgcttggtgggatagtggtgactacggctgcatgactccagagggcacgcttcttctaaaagaccgtcaggttgacctcattgagcacatcgacagcaaccttgccttggaagacttattgttggataaattggactttttatcagaagtcgtgattatccgcgatgtcaatggtgcaccgcagccgattatcgctctggcagaagatgctgagatgaactgggaagcttggtgggccatggttgcagacctaccactattgaaagagcccatcttgatggcttatgacgacattccacgtactgcgactatgaaggttcaacgcctcaaaatggaagcagaaatgaaagaaaaaaatctgtaagagtgacgaaaccacgcttgcagataagaaggagttcacatgaaagaaatttatctagcaggcggttgtttctggggaatggaaggctacttttcccagatcgatggtattcttgacaccagcgttggctatgccaatggacaggtggagacgaccaattatcaactcctcaaacaaacagaccacgcagagacgctctatctagcctatgatgagactcgtatcaatttgcgggaaattctcctctactatttccgcgtcattgatcctttctctgtcaatcagcagggacctgacaagggtcgccagtatcggactggtatctattacacagatgaggctgatttgccgaccatcgagcaggtcatgacggagcagtcccagctctttggtggacgccccctagctgttgaagtggagccactcgcacattacattcccgccgaagactaccatcaggattatttgaagaaaaatccccaagggtactgccatatcgatcttgggcaggcaaaaatccctctgattgatgttgcggactaccaaaagccagaccagcaagtcttaaaagacagcttgaccgacctccagtatcaagtcactcaagaagctgcgacggaaagacccttcgaaaatgagttttggaatagtgaacaagctggcatctacgtcgatattacgactggcgagccactctttctctcgacggacaaattcgactcaggctgcggctggccctcctttaccaaaccaatcagcaaagaagttgcgacttatttccaagataagtcccacggcatgaaccgtatcgaagtccgtagtcgggctggtcatgctcatttaggtcatgtctttgatgacggaccgcgtgataaaggtggtctccgttactgtatcaactcagcagcccttcgtttcataccgagagaggaaatggaagaagcaggatatggcctgtttttggatttgcttaaataaatttatgaacgcagaaagtctattcgcaaagaataggctttttgtgtattaaaattgtatgtttaaaaagatgattttgatataataatctatatagagattttatttaagatgtaaatgtacagaaaggttatgaaaatgattcttagtaaacgttttaaaaatagaagaaaggaacttggctttactcaaaaggagcttgcagagggaatttgtgagcagagtttgattagtcgagttgaaaaattaggagttgctcctacatcggatatattatttgccttatcacaacgcttacaggtgtctatggactatttttttgatgaaagtgtatcagataaagcgcctgatattacggtatttaaacgattggtggacaaagctctgttcactcgttcctatgatcaactggcttatcttgtagaggcagagaagcagaaagaagctgttcattcgcaggaaagcagtgaatatttaacttatctggcttgtatagtggactttcatcattatcataaggaggatattgcaattggatgtatggaagaacttagtcatcgaatcagtaagaaatctagtttttatctggatgtatacaacagcttggttaatttttatgccttggcttctcgagatgaggatttagatggtttgtatgaggggatttcagaaaagcttagccacttggatatatcaaacacagagtgttttcataagtatatcaagattcgctacaatcacgctcactatctttttaaaaggaagaggcagtcacaggcaattgatgaattgacagacctaattgaaacattgcgagataagaagagttgttattttttggcagatatgctttgtttaatcgcaaatgtcggagagggatttctatcaaaagatgaaattctctcctactatagagaagcagaatgtctattcaaattttttggtccgcaaaatagttatctcagtttaaaagaatatctatcaaaggttatttaataatcaagtatagattcttttataaaaataattaaaatggattgaaaatcgactgttaatatgttaagataaaataaaaaagctatatcaacgaacgtttgaaaacatgttgattttggttacgggttctaatgatagggaggtggtggagtccacctcctttttgtgcaaatggggttcgttatgaaaaaagtatttacttatttatctacttttagcgtctgtctcttctgtatatggttagtgagtctgcaactcgattctttaatttatcattactatccatcggtttccatattaagtcgaggggaagaagtgacctatgaagaagtgtcggatgccctgacaaatttagctgaaaaggaaaatagtctaattgctaagacaataacagaaacagatgatagtgggcgaactactaccagttatgatgtttttgggaagggggagcttccacagggcttggtcaaagcggataggttagtagctagtcaggccaacttagctgaaaattactatgttgtaaaaggtaatctggacatcaaagtggtagaaaacgtcttacagtcactgggattggtggatagctatatttatagaccgaccctattaaacagtttaagtctatttcttggtaggggagctccgagcttaggccttattatctttatactcaccaatcttgcattgacagtagttgggcagattgtctacttgcggtcggcaggtatagagatgctttcaggggtgaggagttggcagattgctagtcgttttttaagagtggatggaagagatatagcattggctacaggaggagcgcttgtttttggattaattgctattttaattttgggttggccaatggtatattatcgttttgtagcaatcggtatcgccttttatgcttgtttgctttttttcctatctttatcgacaagtattggattcatgattgcattaaacatttctcagttacaaaagctaattaagggagctttgcctctcaaggcgatttttgctattttactagtaggtcagtgtttagcggtttgcatcatctctattggtgctagtcgaacgttgacatatgttggagttctccatacactaacgataggagaaaaggcttggcaagaaagacaagatgtttttagtctgtctttgaatcgtgaagcattcatagctgatgaagcgatggcccagcaacaaagaatggcttggtctcatgtaattttagaatcatatgcgaaaaataatgtaatgttagtccagcaccatttacggcataacacaataaaagaacataccatcattgaatccagcaaggaaattcctctagaaagggtgctgtatgtgacgccgaattatatacaatcagaaggtggactgtacgatttcaatcagctggaagagataaagcaattaggtaaaggagaaattgcattattattaccaaagagtttgcaaaatgatgcgagtgtttaccaagcgtattttgaggacatggtaggaaaattgcttgcggatggagaaggatccataagtttgcattcaaatgtttattacatttccgatgagaagcgatggttcatttacaatcataccccgataaattatgagcaatttttacaggctccgttgattgttgttctatcacctgaaagttttgaagaaacgtcctatttttgggaaaatgcgttaccagattttgtatttttcaaagataaagagatgctggaacaactgttggacaaatacaatttacaaaacacaataggtagcttgttatctagcaagcaacattacaacaccctgagaaaaaatgttcaacttgaaattcttatgaccctatctccgacaatccttggaatattcacttccatactattgttcaatacgatgaatcttctatactttgagaccttcaaaagagaaatagccatcaagcggatagcagggatgggttttatcgaattgcatggttcttatctaggagaacaagtcggctccgctcttattgggatgggtttggcaatgtttatgacaaagtcagttattgttagcctaggagtagttgtggctttgttgataaatagttggatgttactgaacaatcaagcgaaaagggaagaaaaaatccagttgagtgtattaaatggcagatagttaatgaggtgaagttagaatgaaaggaaaatttgtacttgtatcgacgatcattctagccgtctttatgatttggttgggcgtcagtcaaaaggagactatgctagttcattattatccttctgtgactactttgtcggtatctgaggacgtgacatattcagatgtacgacagcgattagaagactattctcaacagacggatagtgtcattgccagacgagtgattgagccaagtaaatcaggtggacgtaccttttcttatgataattttagtcaatctcccctaccaagaggactagaggaatttcaggcatcagaaaaggtggagtctgcacttttaaccaaatattttattttccaagggaaagcgacggtagaggagcttcggtctcttcttgtttcgcttggacttgatgaagttcagattcggaagccttcgactattgctactttactcgtatttctgacccaaggtggtcaattcttagccgtactggtctttcttattacgtatatggctttggtcgtgattgctaatgtaaggcagttgcgtacagcaggtatccgtttgattgcaggggattcgcgctggcatttatttctactatctctacaggaaaatgcgaaagagatagctctaactatcccatttgcggttcttccagcagttggactggcctacctcgttggattagatggctattctgtctactatctggtcgcagctctagtgggctatcatttcttgcttggtttgattgtcctttttttcgctgctacatttaccttggccattcgaacctatcactttttacccttgttaaaagggaagatgcccctgcaagggatcctgaccattatggttatgggacaaatgctggctctattggtggtgtcatttgggatggctcaaaccgtctattattcagggatttggcaggaatatcaagcaggtgcccagcagtgggagaatgaaggggattactatagtttagcttggaatatttctgcggatggtcgctcaggactaaattcgcctgaaaattggtatcctttactaaggcaagctttggaggaagacggcgcactctttgtcaaaagtaatttgaatgcctatttaatgggcttccaactggaagatggaacacgccttgacagctaccatccagctggaaacaccctctacgttagtccaaattatttgcagatacaggatgtagacttagcagaaggagaagtagcgctccctttacaagaaggagaatttcaacttctgttgcctgaaaaattgcgccctgaaagcgatgcttatctccatctttaccaagattatatcaatcgtatggttagacctgctaatcaagcacgctcagctaccattaagggaaaagttgcctatttaaaaaatgggcagaagcagtttatctacaatcatcgttctggtcaacatgtgcaatacctgacagaccctattttagttgtgctggcaccgtcaagtctgggaaaagaatctgctgacttttggttgaatgaagtagatagcagtatgctatttaaaaacagagataaacttttacgtgaattgaaggcaagaaatttgtttcagtttgtcaatgaagtgagaagtagttcttccctctttacggaacttttagatcgtattcggatagagaccatttcaacatctatgggtgccattttagggattgtgacatcaattgtcctgtttaataccatgaatcttctatactttgaagaatttaaacgtgagattgtcatcaaggaaattgcagggatgggtttcttgggaatccataagaaatacctaacgcttcaactgctttctctcttgttggctcttggagcaagtatggtagtaacaggtcacatttttataagtagcatcagttttgccttgtttatggtcaatgccctctgtttattgaggtggcaggcgaggaaagaaggagcttggaatgtccgtattttgaaaggagcctagtatgttttctgtccaatcaattcaaaagaaatttgggaagcgcagcttgttttctgatgtaacactagacttgcaggctggaaaggtctatgccttgataggtgccagtggtagcggaaaaacgaccttgctgaatattttagccaagttggagtcctatgatgcaggtgacattctctacaagggaaaggatttgaaaaagttgaagccccatctcttttttagggaggaattaggctatctctttcagaattttggtcttttagaaagtcagacaatcaaagaaaatctggatttgggactgattagtcagaaattgtccaaagacgaaaggaaatcgaggcaggaagcggcacttgatgcagttggtctgtcttatctggacctgtcccagcctatctatgaactctcaggaggggaagcccagcgggtagctcttgctaaagtcatcctgaaaaatcctccattgattttagcagatgagccgacggctgccttggatcctaagagctcccaagaaattatggatattttgttatccttgaagagcccagatcggttaattgtgattgcgacccataatcctttgatttgggagcgagcagaccttatcataaaaatggaagacttgtaaaaattcatactcttcgaaaatcaaaattatccgttgtcaacttaccttgatgaactccagttctatcttcggcttcgtttcctaggctacttttgattttcattgagtatcagaaaatattcttgattttttcgtgaaattagattaaaataaaactagataaaactgaataaccggttgatattgggtagaagggaaactgactgttcaatggacggaactctggagagaccattttggcaccgaaggggcaaggtagtcctgcttggaaaagtagagctactgaaactctcaggtaaaaggacagagcgttgaaaaataggctttttctgtatttttcacgttgattctagaggttgaagtgttcagcctctttttgtttttccggcagctttatcgggttagaaacgcttaggaggaactatgttagaactatttaaggctatcaacaatcttgtttggggaccgcccctcttgttactattggtcggaacgggtgtctattttaccctacggttgggagtatttcagattggcaaattgccgacggcttttcgtctgattttctccagtgaccagtctggtcagggagatgtgtccagttttgcggctctgtgtacggctttagcagcgacagttggtacaggaaatatcgtcggagttgcgacagctattactacaggtggtcctggggctcttttctggatgtgggttgcggcctttttcggaatggcaaccaagtatgcggaaggatttttagcgattaaataccgaaccaaggatgccaacggtcaagcggcaggtggacctatgcattatatcaccttggggatgggacagaagtggaaacccttggcagttttctttgctatttcaggtgtattagtagctctcttggggattggaactttttcgcaagttaattccatcactgcttctttggaaacgagttttggattggaaccgccacttgtcagtgtaataacggctatttcaattgccttcgttgtttttggtgggattgaaaaaatctctgacgtttcgaccaaaattgttcctttcatggcgattttgtatatcttagcaagtattactgtcttggccgtgcattgggatcaactcttgccaaccctggccttagttttcaaatctgcctttactccagcagcggctgtgggcggttttgcaggtgcgactgtgcaacaagcaattcagcgtgggattgcgcgtggggttttctcaaatgaatctggtttgggttcggcgcctattgctgctgcggctgccaagtctgataatccagttgaacagggcttgatttctatgacgggtacctttattgatacacttatcatctgtaccttaacgggttttacgattctagtaactgaccagtggtcggtagagggcttggcaggtgctcctcttactcaggcagcttttgcaacagtttttggcaatacaggatctattgccttgacgattagtttggtactttttgcttttacaactattctcggatggtcttactatggtgaacgctgtatcgaattcctctttggcaccaagtctatcttgccttaccgtctggtctttgtagctatggttgccttgggtggtttcctcaaactagacttgatttggaccatcgcagatattgtgaacgggctcatggcactaccaaacttgatcgccttactagctctctctcctgttatcatcaaggagacacgccagtattttgcaaagaagaaataagataaaagtcagccacttggctgtctttttgttcttttagggtgttttctgctataattatctcatgaatgattttattaccaagtatttgtctcaatttaatattgaggccattgtgacagcaggtctaaataaggttttatcgcttgttttactctttgttgcattttacattatcaagaagatagccaaagcttctgtgaaaaaggttttggttccctctctaaaggtatctacccaagacattggtcgtcagaagaccatcagtcgtctggtggaaagcatcctaaattacctactctactttatccttatctactgtattttgagtatcctcggtttaccggtatccagtcttcttgcaggagccgggattgctggggtagctgttgggctgggcgcacaaggttttctctcagacttggtcaatggattctttatcttaattgaacgacagtttgacgtcggagatgtggttaagttaaccaacgggcccattaccatttcaggaaccatcgttagcatgggaatccgaacaacacaagtacgtgatgcagatgggacattgcattttattcccaatcgcaatattctagtggtgtccaatcagtcaagaggggacatgcgtgctcaaatcgatattccgctcaaatttaataccgatttggaacaagtctatcgcgtaatagaagaggtcaatttgagagaaatcagcaattttgaccagattacaggtgtgactgtattaggtccccaaaacgctatttcgggacagtttgtatttcgtgttaatcttttcgtagccaacggtcaacagaacaagatctatcatcaattctttggtttttatcaagatgctctgcgtcaagcaggaatagatttaccttcaagtgggccaactgttttaaaataaggagtttattatgcaaacaaaagattttgtcgttgaaaatgggcagatgtattataagaagaaacccttgcacaaacagcctctcttttggacgaccattgctggtgccgtcctctccttcatcctaggagtaacctgttttatttttatgatcggcctaagctcagcaaattttgataattgggatacaggtagtgacggatacattgatgagactgtggaatacacagagtatcaagttggtgactcagttgatttttctaacggtcttcatgtaacagtaacatctatgggcaaagacgatagcatagaactagtggatagctactacagcacagcttatgttgttgaaatggaagttgaaaattcgaccgcaaaagagctctattttgatgaatactatttcagtctcatggatcccgttagtcagattccctttaccctggatttgcggacctatgatgtgaatctagttgaaaagttgaagccaggagagaaagtacaagtaaaacttatctacggtatagataatgaaacaaactttggttttacctacgaagatgccatgtggacggaattagtcgcagaaggtatctaattgctgtagaaaaagttttaaatattgcacaattttgcggttttataacgccccttggttcagattgttcggcttggtaattgtactatatccgacttatctgttatttttacatttaaaaaaggagaatatgtttatccactgttctcctcttcttttaatgaaaaatacccccaaaattagcacgtcaattttgggggcgtttttattatagtttagtaaactaaaagtaagcttataccaaaccttgggcaatcatgctatccgcaatttgttcaaaggctgcgatgttagcacctgcaaggtagtctgtaccaaggtcgtatttttcagcagtttctttggctgtgttgaagatgttggccatgatgtctttaagacggccgtctacttcttcacgagtccatgacaagcgaaggctgttttgactcatttcaagggcagatacagctacaccaccagcgttggcagcttttgcgagtccgtagagaacgccattttccttgtagactttgatggcatcaaggtcagatggcatgttggcaccttcagccacacagtacacgccattttttacaagggcagcagcttgtttgccgttgatctcattttgagtcgcacatggaagggcaatatcagccttgccatcgtagttccatacagaacctttgaagtacttagcagttgatttttctgcagcgtattctgtcaaacgagcgcggcgtttttctttgatgtccaccaagaggtcgaagtcgataccagtttcgtcaatgatgtaaccatttgagtctgaaacagaaataacttttgcaccaagttcagtcgctttttgaacagcatattgggcaacgttaccagaacctgagataaggacagtttggtctttgaaggatttaccgtttgctgccaacatgttatcagtgaagtaaaccaaaccgtaaccagttgcttctgggcggatcaatgaaccaccgaagccaagaggtttaccagtcaagacacctgcatcaaactggcggaggcgtttgtattgaccgtacatgtaaccgatctcacgaccaccgacaccgatgtcaccagcagggacgtcaagtgaaggtccgatgtgtttttgcaattcagtcatgaagctttggcagaagcgcatgatttcagcatcagtttttcctttaggatcaaagtctgaaccacctttaccaccgccgattggaagaccagtcaagacgtttttgaagatttgctcaaaaccgaggaacttcaagatggattggtttacagttgggtggaagcgaagaccgcctttataaggacctacagctgagttgaactgaacacggtagccacggttgacttgaacatttccatctttatctgtccatggaacacggaagctgatgatacgctcaggctcaacgatacgagccaagatgttttcttcgatgtattctgggtgtgcttcaaaaacaggctcaagtgtagagaagagctcttctacagcttggaggaattctgtttcatgtgggttgcgggctttgactgcttcaaaagaagcttggatgtaagctttggcatttgacatgggatcacctgatttcttttttatttattaaattgtctgacaatttaatttatctgataattattatagcaccatgatttttaaatgtaaagaagaaaatgtaagaatttaaaaaaattaataaatttttattgcaaaatccgaatgttagtagtaaatgaagaaaatccgtttgtttcttatgatataatcaagaaagaatgacctatatggaggataagatggtttcaacagtaacgacactcggtggatttacctttgataattgtttgatgaatgcagcaggggtttggtgcatgaccaaggaagaattggatgcggttaagaactcgaaggcggggacttttgtaacaaaaacagcaaccttggactatcgcgcgggtaatccagaaccacgttatcagaatgttccgcttggttctatcaattcgatgggcttgccaaatcagggcttggcttactatttggattatctactagaattgcaggaaacggagccagaacgcacatttgttttatctgtagttggaatgtcgcctgatgagactcatgaaattttgagaactgtagaagccagtgattttaaggggctgacagagttaaatctttcttgtcccaatgtccctggaaaaccgcagattgcctatgattttgaaacgacagaaaccatcttgcaggaggtcttcacttactttaccaaaccactcggtattaagttaccaccttatttcgatattgtgcattttgaccaagcagcagcgattttcaaccagtttcctttgaagtttgtcaactgtgtcaattcgattggaaatggtctttatatcaaggatgagtcagttgtcatcaagcctaaaaatggttttggtggtatcggtggagagtatatcaagccgactgctcttgccaatgtccacgctttttaccaacgcttgaaaccggagattcaaattgttgggactggtggcatcttgacaggtcgggatgccttcgaacacattctctgtggtgccagcatggttcaagttggaacaaccctgcaaaaggaaggtgtggcagcctttggacgcattacggctgaattgcaggccatcatggctgaaaaaggctacgagaccattgaagattttcgtggcaagctacagcacttagatgactgagatcatctgttgaagacataaaaagaagctaacattgtactgttctcccagatagtcttttagggagtcgcgaggggataatgttagctctttttaaatggtctgtgaagatcggtctgataatcgtttgaggaatggaatacatagtcagaaacatatatttgtgagatggaattctgattttatttagattttttagcaaaaatatcgtatactaatattagaacctctatttataagtgatgtgcttttatggaagaaatagttttttgagggactgctgactgtattttgaacaaaggttcttaagtagggagtatgagggtaaaggtatggagagaagggcgaactatattcgcagaaaacgatatgcgtcctatcggacaaagatgcatttgttttttatttgtggcttagcgactattatcttggcgattattattgtaagcgagcacctagttcctaggctgaatcaggcctcagaatcaatgcactcagataattctgttcgcatcatggctcatggggatttgctctatcacttgcctattcttcgaggagcagaacagccagatggaagttacgatttttctgagaattttacctacgtaaagccctggatagaacaggctgatttcgctatcgcagactttgaagggaccatttctccagatatcgaattagcaggttacccactttttaatgcgcctgccattgtcgccaacaatatccatgatgcaggctacgatttggtggacttagcccacaatcatatcttggactcacatctatcagggctgatttccactgtcaatacatttagagatgcaggtgtggatacagtcggtgtctacgccgaaggcaatcgggcaactgcaccactctacattcgggaagtcaatggtatccgtatagctgtcctagcctatgcttacggtttcaatgggatggaggctttgctgagtcaggaggaatatgatgcctatttatcggattttgataaagaaaagatgcgggcagagattgagcgagctgagaaagaggcagatattaccatcgtcatgcctcagacgggtgtagaataccagttggagcctacggaggaacagaccagtttgtaccatcaaatgattgattggggagcagacatcgttcttggtgggcatccgcatgtagtcgagccgacggaaattcttgagaaagatggtcagagaaaattaatcatctattctatggggaattttctatccaatcagcgtatcgaaagtatggaagataccccaaatgcccagtggacagaaagaggtgtcttgatggaccttactattcagaaagagaatgggcaaacaagtattcaaacggctcaagcccatccaacctgggtcaatcgcctttcaaaagggacttattcaacagatggatacgaacaattttcctaccagacttacattttggaagactgggtcgctggtggtcgatactatggacaattggatctagatacacaggcgcgtgtggatacagcctatcaagaaatgaaagactttgtcaatttggtatggtgaggagagagaagatgatagttcgattaattgcaacagacatggatgggacctttttagatggtcaggggaattttgatagagagcgattttcacgggtcttggatcaactagatcagaaaaagattccttttgttatcgctagtggtaatggaattgggcgattactacaattatgccaaggatttgaagacagattaatctttgtagcggataatggagcccatgtgtatcaaaatggcaagacagtaattcgtcgggctattcagcaagtggaagtcgaagcaatactgcattttttcaaaggccgttgggcggatgtatgtctgatgttgtcgaacgatggaaatatttatatgcaggctggggcaggtatgccgtttgcaggaactgatttgccaatagaactagctcagatggctgccttccaaaatcgtgtgacatatttagacaaccttagtgcctatccagtttcagagtcaatacacaaggttggtctctgggttcctgaagcgcgtgtagaatcgataacggaagcctttaatcagggttttcacggtcagttggtggctgtaaccagtggttatggttccgttgacattctaccgcagggtatccataaggcttggggcttggaacaggttttgaccggtctagatatcgaacctgaacaggtaatggccttcggtgattcagacaatgatattgagttattgtcctatgttgggtattcctatgccatggaaaatgcgacagacaaggtcaaggcggttgccaaatacatggctccaagccatttggaagctggtgtgcttcaggtcattgaagaatatatcttataagtatatagaaaaaagctagtgctctcaatccagagaatgctagctcttttaatttccaacgctggtgaacttggtcataccatagcggaagaggttataattgatggaaaataggaccactaccaccagaggcaacgccagtccccacatagacaagtctaggaagtagagagcagggaagtaggcggtaaaggcgtaggggaaaacaaaaatcagcaggatttgaatgatttttggatagatattgagtgggtattgagccatctgattgagggcgaaaattcccatagtcaaaggaaatgattccacaatccaaaatgctagagcagttggaccgagctgaatggctgcatagagtaggccgatacaaatggcaataaagattagtaaggctagttttccaagactccattccatgcctagctcatttgaagcttggactagtgcaagggaaccgatgagggttgttccgattccttgtggctggattcgttcacagataagttgaaaaagtgggttcacaggcatgaggaggaggcgttcaaattcgccttgtcggatgtagcgactgccaaacatccagagattgtcaaagaatatcaggtgaatggagcgtccgacggtcgctattccatagataaaaagcatttgaccgtagttgaaaccagcgatttccttgatatttccaaagagaatattgaggaaaatcaggtagacaatttgttcaatcaaagaggagaaaagcccgatgaagaagtccacccgaaaggacatctgggccatcatgtagaccttgatgttatagagatagaggctgatatatttcttcatgttaacctccaaaaatgacaatacgacgcttggcttgggaccaaagagcagcaatgaagcaggctaggatgggtatccatataacttgcaatcccaaagcagttagatcgctttcctgtcccaataaaatggaaactggaacgttaaccgcataattatagggaaggagcttcaaaaagttttccacagcctgtggatagaagctgagtggcaaaagcgctccagaagctagattgaaaagtcccattctcagaagcatgactccccaggcattgaccgtaaaaaatgctaagaagccaaaagccatatccagtaattgaacgataaacatccctaggatggagctgactagaaagagcaaaatagtttttccgtcaggtagataaaaatcctgatgaacaagtaagatgccgataaatacgatagcaaattttatcagttccaagagcttatttccaaggtctttgaaaaagagagctaggataaaggaatagggtctgagaaattctccagcaatgcttccttttaaaatgctgtaggataaatcttctccgagtgagaaagaatttaaactggctagtagattagcaaagatgatatatgtagtaaaggtttgtagggtaaagccattgacttctgattgagtgaagaaaatggttttccagacatagagagctaccaaaatcttcactgccagtgaaacgaaggtcgctagaaagaaagccttatactgcatagcattcatcatggtcaggcgggtcatgtagagatatttacgcatggataccctcctcataaatctgacggaccatggtttcaatttccaattccttcatggtgacatcttcaattgaataatgattgaaaacttgctcaatcacctgggcgctggtccagaccttgctttggtagtggatttcaaagtgaaaatcatctttacgaataaattcccagccctccaattgcaaatctttttcaattggtttttctgtggagaagagaatggtcttgactgtggaaaagcgttctttgaggacggtcagtgaaccatcgtagaccttcttgcccttatcaatgataaaaatccgctcacagaggctctcgatgtccttcatatcatgggaagtaatcaaaaaggtggtctggtattcttgattcatatagcggatgaaggagcgaatggtctccttgacgctggcatccaagccgatggttggttcgtccaaaaaaacaacggcaggctggtggataaagatagccgcaaattcacagcgaactcgttggccgagtgacagattacggattggttgcttcataatatcagccaagtccaatagctcaatcaagacagccaatcgctctttgaataccttatctggaacatcataaatttttgcgtgaaggataaaagattcttggacaggtaagttccaatccaagtgagatttttgtccaaagagaacgccgatttgcttattgacagctttgcggttttcttgtggattgagtccgttgatacgaacctgtccttggtctgggaagaggactccagtaagcattttgatggtggtggatttaccagaaccgttggagccgatatagccgatgatttttccttttcctacctgtaaggaaatgtcttgaacagcagggattgactttttctttggcttgaaaaaggccttgatagagccttttagaccgacttccttatcaatgattgaataggtttttgaaagatgttctgcctgaatcatatcataatctcctatttgaaaacgtttgcgtaagataaggatattataacatattccccagaaagtggcggtaaaaagtcgcctttaaggtaacatttttattagaaaatcggtcatatattgaggagattcttgcttaccatttttaatccatacctgcatgataccgaagaaggcatgtgaaaaatagatgctgctgtattctttttccagttgtgataaattctcttttcctaagcgctccgctaaatcattggcaacaagaagtcggactttattgataagaaaattttggatttcttgagttccgttatgggtcagtagggcagaaagcaatttttcacgatagagcaactcgaaaatttctaaaaatgatgattggcgattgccatcataatggtcaaatatagcctctaatttgtgaaaaagtccctgttgataggagtcgattaattcatatttatccttataatgggtataaaaactggaacgactgataccagcagtctgggctaggtgtgttgttgtaatgtcattaaatccttgtgattccaggcaggttaccatggcttctaaaattgcctgtcgagttcgttctttccgactatctgttctcataatttctccttttgaacatttttagacacagtgtctaaaaacagttcttctgacttgattttgaaattgatacttgtataatgtattttatcagtttttggacagtatgtctaaaggagttgcttatgttacaaaaagtaaagaatattttcaaaaaaccaatgaccttgattaccattctaggtattgcctgtgtcccagctttgtataatattagttttctaacttctatgtgggatccatacggccgactagaccagctgcctgtagcagttgtcaatcaagaccagtcggcgagctttcaagataaaaccctcacaattggtgatgatatggtggacaatatgaaagagagcaaaagtctggatttccactttgtatcagaaaagaatgcggagaaaggcttggaagaaggggactactatatggtcatcactctaccagaagatttatcagaaaaagcaaccagtctcttgacgaatcagcctgaaccgataacgatttcttatcaaacctccaaaggtcatagctttgttgcttctaagatgggcgaatcagctatggagaaattaaagacatctgtttcagagacaattaccaaaacctacacgactgccgtttttgatagtatgagagaaattcaaaccggcatgatcgaggcggcagatggtagccaaaaattaacaaatggagctagtcaattggagtcaggcagccaaacactttcaaatggactgactactttaacgacttcgggtcaagtactcgtgacaggagcaaaccaattggccaccggagttgtgtcttatacagatggagtcaatcaggctgcaacaggcagtcaaacactgtccagtggcttaacgatttacacaaatggggtagcgagtcttgtttcaggtgcggagcaattaaatgccaattcctctcagctcatcactggggtgggacaattgcaatcaggagcaagccaggttgaacaacttgtaacgggagccaatcaattgcaggcaggcttggaacaactcgctaattcaactagtttgtctgctgaacagtctagtcagatacaagcactcttgacagggcttccacagttgcaggtggctatcaatcaattaaatgacagcctatcaagtatcggaggacttgcagttgataactctactctatctagcctcttgacggagatgggggctcaggctcaaggcttgttgacagcagcccaagctgataaaacagccagcatcgaagccttgcaaaccacggctacctatcaaaacttgacagctgatcagcaagctgaattggttggtgccctccaaaattcaccttcggcaacagcgacagtagcccaaacgattttggatcaattgtctcagctcagtcaaaccctttctagcctacaaagtctttctggcatggcaacacaaatgaaccagctacaatcagctgtcggtcagattaacacggctgccaatcaagcattgccaggagctacaacagccattgaaagcctatcaagtggcttgagtcaggtcaacacagctttgaaccagcaagttctaccaggaactcaaaccttgacgagtggtgtgagtcaacttcaaacgcaactgtcaagcggagcgagtcaactcatgtttggagtaacagcctataccgcaggtgttgctcaattagcagcaggtggagcccagttggttgcgaataatagtagtatccaatctgggggtggccagctaacatcaggattggcaaccttggcatccaactccagtcaacttgtcagcggttcagaacaactggcttctggtagtcagcaattaattgctggtgcggatcaattagctagtggtggccaagccttgacaagcggtatttctagtcttcgtacaggtagtgagaccctaacgaattcactcagctcagccagtcaacaactatcagtcgtctctgtagaagacaaaaatgcacaagcagtttctcaaccagtcaccttggaacacagtgaccaagatgatgtgaagaccaacggtgtcggaatggctccttacatggtatcagtcgcactgatggttgcagccttatcagcgaatgttatttttgtcaaacacattgataatcgctcctacaagaatcgttgggactgggccaaaggaaaactcttgctcaatggtatcattgccagcctagcagcagtgattctgtacggtgttcttcgcttgattggaatcgaaccagctcatccaatggcaaccttgggaataatcctcttagcctcttggaccttcatggccctcgttacagccttggtgggctggaacaatcgtttcggatccttcgcaagtttaattatcttgttactacagcttggatcaagcgcaggtacctatccaattgaactcagcccacgcttcttccaagtcattcagccctatcttccaatgacctattctgtttcaagtcttcgtcaaaccatttctatggttggaaatagtagtcatcaagtttggatgctaagtctcttcttagtaggctttatgggactaggtctcttgatttataatcaaaaagatgaataagaataaaaccaactgctccatgtgaacagttggtttttggttgatgtggttatttgggggtccctaaattgattgtcgcattggtggcttcaatggtcagtttgttcttgctacctttgttttctagggttagggtctgtagatcgttttcagtcttgacagggaatttggtgtacttatcgctagtgaaaataccgacttcccctagtcgctcttttaagtaagggtcttggttaaccatctctcccaaatcattcccatcttcatagtagtaaccttgggcttctactaattttttcttgtcgatctggttggtgatgagcaagttgctatctgccaggctcttgtccgtcacatccaaaaatgtcgtagaggagtaggtgtcggatggagtgaaacgattatcgccaagaagagtcgtttgtctgctatccagctggctatagccctcgatggtcacattttccaaactggtttcatacaggcggacgctgcttccctgtaggttgatgtgcatatcttttagagtggattgtgtcgcttggaagtagcctgcttcaatctgaccgctgtcaatagtcaccttgtcaagagtgacaccaccagacagatttgcctctttgatatggatattctcaatcgtgaaaccgccaaaatcatagaagtggagattgtgtccctctaatttatccagtgtcttccctttaggcacttcaatggtgacggagaagacattgatacgacgctgggccaagctttctcccagatactgcatgattccctcaatggcaaattctagttcctgtgcagagagggttaagacgccgtctttctcactgagttttagagggttttggatattgttgtcggagttggcataggtcacatgatagttgttatcactagactctttgatgtagacgctgtgggggataaaatcaattttaatggtattcaaatctgtgaaggtcttatggacttccgtcggagcagcaacctcttctaagcgggttatgcctccggtgaaaaatccaatgccagctagaattaagcctgcaatcaggctgacaaagccgataataatggcgatggtaagtttctttttcatgctcgtttacctcgtttcaaaatccatttgaagcaagccttgaccagtcgccaagaccagtaggcaaaaaatccagtcaagatgtagatgagaatagctccgccaatcaaagacaaacctgacccaaaccccatgaggaagatattgaaaccttctgacataaggctaaaggcttcccaaattagatagccaccgctggtgagaagtccgacacccaaaacaaaggcaccgacaatgagggccaagatgagcgccaccaatcccaatagactagctaggagaatgagcaaaagtggaatggcgataggcagggaaatgacagctaggatagccaaccagagcgttcgttttgtttggctaaaattacggaagtagcgaccgaggaaaaaagcgccgaggataagagtcgcaaacagaggaatgactccgataaactctcccatgataaagagtaggaagaaagagaagagacctgtcatacttaaggctcccagaccaacccagagtttccagttgagttgaataggttcttgttgatccttctcctcctggatttgcttgttgagcatgttgttaatgagttcgctggcagcttcttttggggaaccaagttcttctataatttctgtttcacgctctggtccaacctcgtcaaaatactcattaaagaagctgatggcttcaaagtattctttgtggggcagttttttgagatatttttctaactgctccatatattcagttcttgtcatggcggacgctcccttctatgatgccgtttatcgtgtttgtataggtatcccagtcatctttgagtcggaccaattcttcgtgacctaactgagttaggctataatactttcgcatacgaccctgatattcttgggaataagtagtcaaaaagtcattttgctccaatcgttttaggatgggatagagggcggactccttgatgttggcaattaatttaatggtctgacagatttcatagccataagaatcatcggattccaaaatagccatgatgagaaattctgtcagcactgcggggactggaaaatgcataggacgctcctttcctttgttgttagttaggttcggttttgatatatagtgttcggttgcatatatcaaatttttctatatattaaatatacacctacaaaaataaattgtcaagtgattatgtgcaaaataaataaaataacttaagaccaaatagcttaggacaaatttttaaggtgtaaacgttttatagccttgaaaaataatttcagagtagtaaacttaataacagtactaacattaagggattttctggactaaaagagaatgacctcagatggattagtagtatttaaggtggtgtaaagatgaaactatatgttcagtttatgattattctggtattttcatttttaggggaagctatttcgactatttttcatcttcctattccgggaagtattattggcttaatcctcctatttttagccctagagttcaaattgattcgtcttcgccatattcatacggttgggaattttttgctggctaacatgaccattctttttttgcctgcagcagtgggcattatggagagatttgatgcaattaaagattatttacttcctattatcgtcgtcattttaggcgccatttttttaaatatcttagtaattggttttgttgttcaatttgtgaagcaaaagtttgaaggcgactacattgatgcggagggaaatcatgactgaacttttttccaatcctatttttggtattatgttatcaattgcagcatatttaattggaatgctgatttatcggagatttcctcatccaatcacaaccccactgttggtagctacaggattgattattgtctttttaaaaatgacaggtatttcctataaggaatattatgcaggagggtcctatctaaatatgcttattgtgccttcaacagtagctctgggtattcctttgtatcgttctttccatctaatgaaacatcacattcgaagtattcttttgggaatttttgttgcctgtattgtcaatactgtctttactgccctaattgcaaaatggtttgggatggatttttttctagcaatctctctttttccaaaatcagtcaccactgctatggctgttggtattactgataaaatgcaaggaatagcaacagttactcttgtagtcgttgttgcaacaggaattctgacaagtgttcttggtccagtctttttaaagctactaaaaattgaagacccggtagctgttggtcttgctttgggaggaacaggacatgccattggaacgggtacagcgataaaatgtggacatacacaaggagcgatggctggcttggctattgggattacaggcatcatgtatgtggtgattagtccaatagttgcgcagattatcttacaataaaaaactacgattggaattccaaccgtagttttttagtctacataaagtttggattgattattcaaccaactataaagaagtccgataaagagaccgcctcccacgtagtttcctaatccagaaaagaggaaattgcttagtacacttaatagagtcattccctcaactggtccaccatttgcaaaaaaggccagggagaagagtgaaaagttcgcaatgacgtgctcatatcccaagaaagcaaagataaagatgatgaaaataacggaaatgagacgtccagcgtcatctttgatgcgtaagaaggtaaatacgccgatattcacgacaatattagcaaaaattccttcaataaattgagtcaaaggtgtctttgaaagcttggccaccgttgcttcaaataggtagctgtgagcatcaacgtgctgataaggcagagtcagtgagaccaagtaacaaacaaggacagcaccgacaaagttgaaaaggatacaggttgccaacatcttgagggctgttttagtaggaatcgtttttcgatggctggctactgtcatatacatcatgttggatgttccaagttcggcattcatatataaaatcatgagtagcccccaaccaaacatcaacccatagctaaatttcccgagtccttctgcgacatggttgagtttgtctgctgtataaagagaaatgacaatccccaatcctaaataaagactggctagtattgatcgtacagcgtaggcagaaaaactgtgttcaaacaaatctgcttttttcttgatactcttttcaagtgtatacattaatgtctcttggttagctcccatcctaatctccttactgaatctactactttttcgagtaaacgttttctttttatcgaatggctttactttgtttattatacttgataaaatggttgttgtccaaaaaaaattcaacttttgaaaggaaatataagaaaaatatggatgttacatggacagtgaaatatatcactgaatttttagcgactgcactccttattatcattggtaatggtacagttgcaaacgttgatttaaaaggcacaaaaggaaacaactctggttggattctcattgcgattggctatggtttggcagttatgatgccagcattgatgtttggtaacgtttctggtaaccatatcaacccagccttcacacttggtttggctgtttcaggtctcttcccttgggctcacgttgctcaatacattgttgcccaattgttaggtgcaatgtttggtcagttagtggttgtagcagtgtataaaccttacttcttgaaaactgaaaattctaaccatattcttggctcattctcaactatcagtgcgcttgataacggaacgaaagaaagccgtaaagctgcgacaactaatggtttcttgaatgagttcgttggttcatttgtattgttcttcggtgcccttgctttgaccaaacatttctttggttcagagttggttggtaaattgattgaacagggctatgataaaacagtcgctgagacaatgactgctccatatacttcaggttcaattgcagttgcccacttaggcattggtttcctagttatggctcttgttgccgctcttggtggtccaacaggtcctggtcttaacccagcgcgtgaccttggtccacgtatcgtccatgcccttcttccaaaatctgttcttggtgaaaacaaggctgattcaaaatggtggtatgcttgggttggtgtatgtgctccaattatcgcatcaattgccgctgttgcacttttcaaattcttgtatctataatatagagaacccgtttcgtcgggtttttctttttctcttggtatatcctatataaagttgtctgctctgctattttcctaaaagttatgctacaataaggatagaaaaatcggaaaagaggctagaatatgtcagatgttattgcttttggctatggaagcagtcgagcgaagatgcagctcaagcggctcaatcgtcatggaatcatcgcaggtgcgacaggtacagggaagaccgtgaccttaaaggtcttggcagagcagttgagtgatgcgggaattcccgtctttctatcggacatcaagggtgatttgaatagtttggttgcggccaataccaaggagattgatcctagtcgtctagagaagactcattatcttgactatagcccagtcggttatccagttgagttgtgggatgtcttgggggaaaatgggactcctatccgcatgactatttcagagctgggacctgtcctactgacacgtttgttgggcttgaatgatactcaggagtccatcctgaatattgttttcagcgtggcagacgagcgtggtctgctcttgattgatttgatggacttgcgggctatgttaaactttgtggctgaaaatgcggcagagctgagccagtattatggaaatattccagctcgttcggtcggtgctatcttgcgtagtctggttgttttggagcaacaaggtggtaagattttcttcggtgagccaagccttgatattgctgatttgatgcgtacggcagaagatggtcgtggtgttattaacgtccttcaagctactcagctatttaatcagccaacattatattcaacggttcttctcagcctcttatcagaactctatgaagtcttgcctgaggtgggcgatttggacaagcctaagatggtcttcttctttgacgaggctcatgttctcttcaaagatgctccaaaagttcttcttgaaaagattgaattgattgtccgtttgattcgttcaaaaggtgtaggtgtcttctttgtaacgcagaatccgacggatattcctgatagcgtggcagcccagttgggtaaccgcatccaacatggtcttcgcgcctttacaccaaaagagctcaagacagttgctactgtcgctgaaaccttccgtcaagaaggtgatgaggatttggccaaggtcattcaggagttgcaagtgggggaagctgttgtgtctacccttcaagcagatggtacaccaagctttgcggatcgggttttgatttatccaccaaagagtatgctgggaacggtggagccaagcgccctcttgtcagttatcaataattctcctttgatggaaaaatatgctgacgcggtcaatcgtgaatcagcccatgagcagattttagccatgacagaggctaaagaagccgaactcatcaaaaaagcagagcaggccgaggcggaaaaacaggcagaaaaagaagctaaggcagccgcaaaaatggaagagaaagcccagaaagaagcagctaaaactgcacaaaaaactagtcagccagccagtcgcaaaacagactctatgatggatcgttttaccaagaacctgatgagtcaggtcggacgggaagttgggcgcgtggtaactcgtggcattatgggcatgttaaaagggaaataaacgactagactgggaaggaaacttctcagttttttatctagacaaagttcttgccagatgccacaaaattcgttaaaataaacacaaatcactagttagtaaggagttgccatgactgatcaattgcaggcattattgaaagactatcagccccagccattgggtgaaaaacgttcttatgcagttttcttgcccttagtctggtcagacaatcagtggcaggtcttatatgagattcggagcgagtccatttctcaaccgggagaagtttcctttccaggtggcggagtagaggtaggagaaacgccacagcaagcggccgttcgggaggttatggaggaactaaatattcaacctgaacaaattgatatactcggagaaattgattatttggttttggagtgctcaaccgttcattgcttcgttggacggttaaatcttgattggacgactatccttcctaatgaagaggttgctcggatatttacagtgcctctatcaactctattaacaactcagccagtctattatcaactggattcacagattgtcccagattgtgactttccctttgaacgtttgagaggtggggttgactatcctttcagtcatcacaaacgctcggttcccttttatgaaaatctatcagaaaatatctggggaatgaccgcccaatttacccatcggtttacggaaatagtgaaaagtaatctatcgtgaaatgataggttatttttgggaggaaaaaccagcctttgcgatatgtatcaacgaaaaaaatggagacaaagctcaatgtgaaccaatgtatataaaaacacaaaaaaaacagatgcatggcagataaaagatagctatggctggtatacttggtacggtccatattttgaagtaccatcatctatccaggaatgcgacaacattcatgtaaacgcattcagtgcttgttgtcatttccagtaggtgagtgggaaaatgtataaatctatattttaagaaggagccaattatgagcaagcagaaagttgtgtccagtttattattaagcacagtcgtattagggggattagccttttattcaacgacaacggttaaagcagaatcgctagaaccagatgttacatcagttaatgcaagcgatgctactaataaaccggtagtaccaaatgaagagggaggcgactttttagctgaagaggagcttgaagatgatgacactttggaagaagaattaaatgagaaagccgaagaggttactgagccatcttcacctgaagcacttctccaacctcgtgcgatgatgagtgattctgaaactagtggtatggaagaaattccgatgaatgatgaaccttcagataatacggaagaaaaggtagagaagcaacagtcgccattaattcaaacctcaaatgcagattataaaagtggtaaagatcaagagaaacttaggacatcagtatctataaatctgttgaaggcggaagaaggtcagattcagtggaaagtaacttttgatacaagcgaatggtcttttaatgttaaacatgggggtgtttattttattcttccaaatggtttggacttaacaaagattgttgataataatcaacatgatataacagcctccttccctacggatattaatgattacagaaattctggtcaagaaaaatatcgtttctttagtagtaaacaaggtcttgacaacgaaaatggttttaattctcaatggaactggtctgctggtcaagctaatcctagtgaaacagtaaacagttggaaatcaggcaatcgtttgtctaagatttatttcataaatcaaataacagatactaccgaattgacctatactttaactgctaaggtaactgaaccaaatcagcaatcattccctcttctggcagtgatgaagagctttacgtatacaaactctaagagtacagaggttacttcgctaggtgcacgtgagattacccttgagaaagaaaaaactctaccacctaaggagaatccaaaaccagagccagaagctccaaaaccagacgctccacaagcgccatcagcaccggaatctccaacggaagaacctaagaaggaagacgctccagcgccatcgactccggaaaaacaaccagaagtaccggaatcaccaaacccagagacaccagacgcgccatcgactccaaaagatgagccgcaagttccatcaatcccagaggagcaaccaaaagagactccagcgccagaagaacctaagaaggaagatactccgcaaacaccacaagcgccatcaactcctaaagaggaagcaccgaaggaagaagttccaacaccaccggctccatcagtaccagaagagcaaccaaaagaaactccaacaccagaagttccaaaacaagaagatgttcaaccggaagcgccaaaatctgataaagtagaatctgacaaacaaatgccagaaactaagaaaccagatatgaagcaaccgaaggcagacgacatgcctaaggaacaaaagccgaaagccgacgagccaaaggcagagcaaccacaaatggacaaaccacaaatggaagctcctaagaaagattcggaagcgccaaaatctgataaagtagaaactgacaagcaattgccagaaactaagcaaccagatatgaagcaaccgaaggcagacgacatgcctaaggaacaaaaaccgaaagccgacgagccaaaggcagagcaaccacaaatggacaaaccacaaatggaagctcctaagaaagattcggaagcaccaaaatctgataaagtagaaactgacaaaccaatgccagaaactaaacaaccagatatgaagcaaccgaaggcagataaaccagaagcagagaaagctcaaatgccacggacagagggtatgaagcctgaatctaaggcttcaatgatgccaaaagcagaggcaccaaaagcaactttgccaaatacaggcgaagcaagtagcgcaataggctggctaggtggtgctttagccactcttgccacaggcttgtatctattcaaaaacaaaaaagaagaatagtcattattgaataagatataagaacttccctcttctaagttcataaaagactccagatcatcgctgtagaagccttggtttggagtctttttgttaaatattcttagaaaataacaaaatagataaatattagataccctctagaaaaaatttagtttaggatgttatactaacgctaaaacaataatatcaatttttgaaaatactagattggaataaaaatctaatcgccatattttagaacctgtacttacaagtaaagagcttttatgtaagagatagtttttcgctaatcaagttaattttttgagggaatgctggctgtattttgaaaaaacgaacgatgagtagcttaaaaatgccttagatgggagtgctaacctgtaaatacaggttcttagtaaattgaagtaaatagagtaaaggagcacattatgagcaaacaaaaagttgtgacaaatctattgcttagtacagctgtactaggtggttttctaatatgtcacgcaccatctgtaagcgcagaaacaggcaatcttcaagaaatacctactgaatctgctacggttagctcagaaaatcaaactgcgaccgcagtcgatggaatttcacctacggataaccaattacctacgtcagaagagggtgataaacaggctccagaagaaaaactagtttctagcgattctacgagagaagaaagtgctacgcaggtagcgacagatccggatgcaccatctcaatcattaagtgtgtcaggggcggaaatttcaacggcagattcaaatattcaacaagccgaagagaaactgattcaagaatcgaattattatagatttgacacgcatcaaggtgaacagattaggaaggcagtatctatagaaaaaatatcggcagataatgacgaaattaagtggaaagtaacttttgatagaaaaaattggacctttagtggagaggggagtggctattactttattcttccaaaaggcttacaattaaccaaaattattgatagccagtctgaagaggatattttcaataagttccctaaggatgtcaatagtgaggcaaattctggcgggcagccgtatcgcttttttagtagagaaaaaaatgctaataatgatgagcgtagttttgaaagtcagtgaggttggtctgttggacgtgtaggaggagagctagaaaaatggaaggaagaaagttccagcatctattttctacaagtacagcgagattccgttgctaaagaaaaagcgacatatgaactgacggcacaggtgacaaatcgagaaatgcagactttcccggttttagctgtggtgaagaattttaaagagcgaatatttttctccagagatgagattacttctgctgctggtttgagattaaaggtatcggaaagtgctaagccaaataatgaagggattactattatcggagattcatctccagaaagcgacaggactcctgaaccgcggggagataggactccggatatagatgtaccaaaggcagaggttccaaaagttgagcaaccaaaaccaaaggcccctgaagttcaactgcctgctcctaaggctccggaatctgtgccaccaaaagtaatgcctccagcccccaaagttccagacgttaagacgccaaaagttgagtaccctgatacagatgctcctgagattgagtcaccaaaagctcctgaaactgaacgaccagaagtcttaccaccgacgccaaaagtcccagaagttgaggttccgaaagtaattccaccgacctcaaaagttccagaagctgagctaccgaaagttgagcagccaaaaccgaaggttccagaagttcaccttcctgctcctaagtctccggaaactgagccacccaaagtaatgtccccagcccccaaagttccagacgttaagacgccaaaagaggcgcctctgccaccaaaaactccgggcgttgaggttccgaaagtaattccaccgaccccaaaagccccagaagttgaggttccgaaagtaacaccaccgacctcgaaagttccagaagttgagacaccgaaagttgagcagccaaaaccgaaggttccagaagttcaccttcctgctcctaagtctccagaagttgaggttccgaaagtaacaccaccaacctcaaaaattccagacgttaagacgccaaaatctccggaagttgcgcacccagaagttgagaaacccgccggaatccaaccagaaaagggtcaacctgaggttaataaacccaatattatccattcggaggtgcttcaatccgaagttaagaaaacggaatctggagtttcaatggctccaaaggtaggaatacaaaaagagactttaccaaatacgggtgaaacgagcaacaccctagtatggctaggtggtgctctagctacccttgcatcaagtttgtatcttttcaaacaacacaggcaaagagaagaggaatgattttacgctaatgctatatttttggaacgccaataaggcttatctaccatggactaagaaaatttagaacagttgtaaatagaaaacgttccaaaatctgaactgcaccccaaaagttagaggtgaaatctaatttttgaggtgcttttcttgtaaggtcaagacacaaagacaagattgaaatttatcgtttgcaatgatatgaaggagttggttatatattttgttttatcaatactagtttgaatgttattcgagaatttgtaggacattctgaggatggtaaggagatagtgaaaatctatcttcatgtaatacaaaaaggaaaacgtaagattgaacaggctatgctagatttagcagaaattatcatttgatttattttaatcagttaaaattcagttattttgtcaaaaacaaaagaaaaaagcctttgaaacgttgatttcataggctttctgtatgttgtcttattttacctcagtaaaaatcacgtgcttacgcaattttggtgagtattttttcaattgaagacggtctggagtgttacgtttgttttttgaagtaaggtacaaacgctcaccagattctttgtgttcaagtgtaatatttacgcgcatggtatctcccttctattattcagctgaagcagccttggcaattttacgtcctttgtagtatcctttcaaagatacacggtgtgaacgtgagtaatctccagtagtttcatcaaatttcacagttggagctgctactttatagtgagtacgacgtttgtttttcttcgcttttgaagtgcgacgtgcaggtactgccatttctttcttcctccattaaatgtcagggtcaagccctttttaaatctaaaaatagtgcgtatgactttcgccaactttaacagtataacaaaagttttttgtaaagtaaagttacttgacagatttttttcacttttttggaaaatagcagagcatttatggtaaaataaggaggattgcaaggctcgactggtagagtttgagcccttatgacttaatttggaaaggaagaagcacaacttcgagcgatataagttggctctatacactttattatgaaactacaaaaaccaaagggaacacaggatttactaccgcaggattctgccaaatggcagtacgtggaaaactttacccgcagcattttcaaacagtacaattacgctgagattcgcacaccaatctttgagcattacgaggtgatcagccgttcggttggcgatacgacggacattgtgaccaaggagatgtacgatttctatgacaagggagagcgtcatatcaccctccgtccagaagggacggcaccggttgttcgctcctatgtagagaacaagctgtttgctccagaagtacaaaaacctgctaagttctattacatgggcccaatgttccgctatgagcgtccgcaggcaggtcgtctccgtcagttccaccagattggtgtggagtgctttggttccaataacccagcgacagacgtagaaaccattgctatggcctatcacttctttgaagagttggggatcaaggacattcgcctccacctcaacagtctgggcaatccagagagccgtgctgcctaccgtcaggctttgattgactatctgacgccgctcaaggaacagttgtctaaagatagccagcgccgtctagaagaaaatcctttgcgtgtgttggattccaaggaaaaagaagacaaggttgctgtggaaaatgcaccgtccatcttggactatctagatgaagaaagtacagtccacttcgaggcagtcaggtccatgctggacaacctaggcattacttacacaattgacaccaacatggtacgcggtttggactactataaccatactattttcgagtttatgacagaagtgggtggcaatgacctgaccatctgtgccggtggacgttacgacggtttggtgacctactttggtggaccagaaacgccagcttttggctttggtatgggcattgagcgcctcatcctagtccttgaaaagcaaggcatcgagctccctctcgatacccagttagatgtttacatcgcggttttgggtcaggaggccaatggcggagcgcttgatcttgttcaagccattcgcaagcaaggtttccgtgcagaacgtgactatctggaccgcaagctcaaggcccagtttaagtcagcagatgtctttggagccaaggctatcattaccctgggtggtagcgaaattgaatctggacaggttgtggtcaaaaataaccagacaagaagtcaagttgaaacaagcttggaagcacttaaaacagattttgcaagtattttagaagaattggagaagcagtagtctaaagctgcttctttttattttagaaagcaaaaaagaagcgattggataatcacttcttgaaaatagtggagaacgcattagtgtgagtggcagaagtctaagaccatacgaccttggatagtaccggcaaccatttcattgaagactgcttcggcatcttcgacagggcgtttttgaacgactggaacaactagtcccatagcaccgaagtggaaggcctcttctaaatctttacgagtaccaactagtgagccgaccactttgataccgtctagcacagtcttcacgatactgaggtccatgtattcagatggaagtccgacagctactacatatccaccagcacgaacactgtcaatagcttggttgaaggctactttggaaacagctgttacaacagtagagtgtacaccgccaccagtaatttctttaatatatccaggaacatcttctacttcaagtccgttgatcgtcacatctgcaccaacttctttggcgagttccaatttatcattattgatgtctacggcgataacatgagcgttgaagacttttttagcgtattgtacagcaaggtttccaagtccaccagcaccatagatagcaatccattgacctggttccaagtgagcttctttaatcgctttgtagcaagtaacgccagcacaagtgatagaacttgcttgagctggatcaagaccttctggaacttttactgcatagtccgctgttacaatacattgctcagccataccaccgtcaacagagtagcctgcattttttacggtacggcagagagtttcgcgaccggttgtacaatattcacacataccacagccttggaagaaccaagcaacgctgacacggtcaccaacttttagactggtaacaccaggtgcgatttctgtaacaataccgattccttcgtgaccaagaacgcgaccaggaaccttaccaaaatcaccattggcaacgtggaggtcagtgtgacaaacaccacagtactcaatttggaccaaagcctcaccagcttcgagtggacgaagttccttttcgacaacgacaacaccagtagattctggatttacaacgactgctttcataagcagacctcctgttttaatattttatgtacatttttggatgtgttaatatagttgttttatattgttaagaatatcacaatgtgaacaaaaatgcaagagtagaaaaggagggacaaatgaatataaaattgaaaattatcacgtaattactacaaaattttcaaaaaaatctatttacatggaagcgttttcttgataaactagtatcgtaaatgttagagaaagaataaatgataaagatttgtcttactttatgtatttttcgaccaaacaaagcagaaacaaatctgaacgttttctgaaaacaggaaaaagtaagcgctttccaaaacaaaacagaaaaaatgtgaaaaaattaacaatttctctttacaaataaaataaaaaatagtagaataacattgtgaaaaagttaacaaatagttagcaagtatatttggaggaacacaatggctgataaaaaagtagtatcaccagaagaaaagttggtagaagcgcgcaagcacgtcgatgagcttgttcaaaaaggtttggttgctcttgatgagttccgtaaacttggtcaagaagaagtagactatattgtagcgaaagcttcggttgcggcccttgataaacatggcgaattggcaatgcacgcctttgaagaaaccaaacgtggtgtattcgaagacaaggctactaagaacttgtttgcctgtgagcacgttgtcaataacatgcgccatacaaaaacagttggtgtcatcgaggaagatgatgtaacaggtttgactttgattgctgagccggtcggtgttgtttgtggtatcacaccaacaacaaacccaacttctacagcaatctttaaatcattgattgccttgaagacacgtaatccaattgtctttgccttccacccatctgcgcaagaatcttctgctcatgcagctcgtgttgtctatgaagcagctgtggcagctggtgcccctgaaaactgtatccagtgggtaacaaaaccatctatggaagcaacgtctgagttgatgaaacatgatggtattgcaacaatccttgcaactggtggtaacgcaatggtgcgtgcagcttactcttgtggtaaacctgcccttggtgtaggtgcaggtaacgttccagcctatgttgaaaaatcagcaaacatccgtcaggcagcacatgacatcgttatgtctaagtcatttgacaacggtatggtctgtgcgtcagaacaagcggttatcattgataaagaagtttacgatgagtttgtagcagaattcaaatcttacaaaacttacttcgttaataagaaagaaaaagctcttcttgaagaatactgcttcggtgtgaaagctaacagcaaaaactgtgctgaaggtaaattgaacgcagacatcgttggtcgcccagctgcatggatcgctgagcaggccggcttctcagtaccagaaggtacaaacatcttggcagctgaggttgctgaaatcggtgagaaagaaccattgactcgtgagaaattgtcacctgttattgccgtcttgaaagttgaaggtcgtgcagaaggtcttgaagcagctcgccaaatggttgaattccacggtctcggtcactctgcagctattcatacggaagacgcagaattggcgaaagagtttggtacaatcgtacgtgctatccgtgttatttggaactctccatctactttcggtggtatcggtgatgtttacaacgcattcttgccatcattgacacttggttgtggttcttacggacgcaactcaatcagtgataacgtaagtgctatgaacttgctcaacatcaagaaagtaggaagacgtagaaataatatgcaatggtttaaagttccttctaaaacatacttcgaacgtgactctatccaatatctccaaaaatgccgtgacgttgaacgtgtcatgatcgttacagaccgtgccatggtagaacttggattcctagatcgtatcatcgaacaattggaccttcgtcgtaataaagttgtttatcaaatcttctcagacgttgagccagatccagacatcacaacggtttataaaggtacagaattgatgcgtaccttcaaaccagatacaatcatcgcactcggtggtggttcaccaatggatgctgccaaagttatgtggctcttctacgaacaaccaacagttgatttccatgacctagttcaaaaattcatggatatccgtaaacgtgccttcaagttcccagaacttggtaagaaatctaagtttatcgcgattccaactacctcaggtacaggttcagaagtaacaccgttcgccgtaatctctgataaagcaaacaaccgtaaatacccaatcgctgactactcattgacaccaactgtggcaatcgttgacccagcactcgtattgacagtacctgcacacgttacagcagatactggtatggacgtattgactcacgctacagaagcatacgtttcaacagtagctaacgactttacagatggtttagcacttcaagctatcaaactagtatttgaaaaccttgaaagctcagtgaagaatgctgactttgtatcacgtgagaaaatgcacaacgcatcaactatggcaggtatggccttcgccaacgcattcctaggtatttctcactcaatggctcataagattggtggacgtttccataccgttcacggtcgtacaaacgctatcttgcttccatacgttatccgctacaacggtactcgtcctgccaagacagctacatggcctaagtacaactactataaagcagatgaaaaataccaagacatcgcacgtcttctaggcttgccatgctcaacaccagaagaagctgttgcagcatacgcacaagcagtttacgacctcggtgaacgcatcggtatccaaatgaatttgaaagcacaaggtatcgacgagaaagaactcaaagaacactctcgcgaattggctcttcttgcctacgaagatcaatgtaccccagctaacccacgtctagcaatggttgaccacatgcaagaaatcatcgaggatgcctactacggttacaaagaacgtccaggtcgcatcaagtaaggattttcgtcacgatacatcgttaaagctccttgcctaactttagttatgcctacgtcgctttgccttgtctcgtttagaaaatcattccttagtgatttagattcgccttcgtcaatctgcctagaaaggcttaggactagaaaaagtctaggtaggagtagtaaatcgtatcctactcagttgaacggagtaggatttataggtaaattgcctccaaatatcgtaagacaatcctctattgaaaaataggggattgtttgtttagaaataatggtggagattctgtaaaaagcgaaagtggttggaaagttagggtttagccgagaaaaagagacttttctatctatctttcacaattttctgtcaatttgtggtagaatagaaaaaatagattttttatgagggataccatgacattagtatatcaatcaacacgcgatgctaaaaatactgtatcggctagtcaagcgattttgcagggcttggcgaccgacggtggtttgtttacaccgctttctattccaacagttgacttggatttttctgttttgaaagatgcttcttatcaagacgttgccaagctgattttgtcggctttcttggatgattttacggcagatgagttggactactgtatcaataacgcctacgacagtaagtttgacacgtcagttattgccccagtggttaagctaaaaggtcagtacaacttggagctcttccgtggctcaaccattgccttcaaggatatggctctgtccatcctcccttacttgatggcgacggcgactaaaaagcacggtttggaaaacgaaattgtcatcctgaccgcgacttcaggcgatacaggcaaggcagccatggctggttttgcggacgttcctggcacacaaatcattgtcttctatccgcgtgacggggtatctaaggtccaagaattgcagatgaccacgcagacaggggctaatacccacgtggtggctattgacggtaacttcgacgatgcccagaccaatgtcaaacacatgttcaacgatgaggcactccgtgccaagttggcggctaagaaactccagttttcatctgccaactctatgaacatcggccgcttggtgccacagattgtttactatgtctatgcctacgctcagctggttaagactggtgagattgcggcgggcgacaaggtcaacttcaccgttccaacaggaaactttggaaacatcttggcagcttattacgccaaacaaatcggtctgccagttggcaagctcatctgtgcgtccaacgacaacaatgtcctaaccgacttcttcgcgacaggcgtttacgataagaaccgtaccttccgcgtgaccaccagtccgtccatggacatcttggtgtcttctaacttggagcgcttgattttccatctctttggcaatgacgctgcaaaaacagctgagctgatggaagccttgaacacagctggtcagtatgacattcaaggggctgacgcggaaatcctctcgctctttgctgccgcctttgcgacggaagaagaaaccgctgcggaaatcaagcgtgtctatgacgagtcagactacattgaagatccacatacggctgttgcctcagctgtctataaacagtatgtggagcaaacaggggaccaaactccgacagtgattgcttctacagcaagtccttacaagttccctgtggttgcggtagaggcggtgacaggccagtcaggtttgtctgactttgaagcccttgcaaaattgcatgagatttcaggtgtagacttgccaccagctgtggacggcttggaaacggcacccgtccgccacaataccgtcgttgcagctgccgatatgcagactgaagtagaacgctatttgggtgtttaatttcgatttattttatgacaaactgctcattttgaacagtttgttttctttttgtggtttaaattaaaatttacagataattcaaagaatgatatactatataggaatactgaatagtgaggtggatgatggcacaagagcaggagaaaatctccagagaaaagaaaaaagccctcttgaagcggctcaaagaacgcatcaaacccaagatgaagctggtttatttggcagcctttctatcatgggtgcaatttttgatgcggattatttccttttatctgattgctaagggctttgtgagctactatgagggtggtcaggttgatctggtacgctttgtcctcatcttgctggggctcaatgcttttggctatggtgtggctctgattgccaagcgtttgcaggggctgggctcccagtttgcacgggattcgctcaagcagtctttctttgaggttcttttggccaaggatggtcagtttgcgtccaaagcgacggcggcggatgtttttaacatcgcttctcaggggattgatagcctggatacctactattcctactacatggcttcgtccttgcggacccagttcaactgtgcgacggttctcttgctggtttttctgattttcccgctgggtgcagtcattttcatcttggccttgcctctgattcccatttccattatcgctatgcagaagcggtccaagcggatcatgaatcgctattggggttcctatatggatgtgggcaatcttttcctggatgacctcaagggcctcaacaccctctattcttatcaggcggatgccacctacgaaaagaccttcaatgaacaggccgaggacttccgcgatgcgaccatggagttgctcagctttcagttgcaagcggtgggctacatggatgcggtcatgtatctggggattggcttgtctggttttgtggcggtcaatagcctagcagcaggcaatttgtccctctttagtatgctcttctttgtcctcattgcgacggagttttttgcacccatacgggaacagggctacggtatgcacttggtgatgatgaataccaagatggcggatcgcatttttggtttcttggacagtatgacagcggagcaggaaatcgattctgtccatgtgcctgcttttgacagtctaaaactagaagatttggcctttgcctacggagaaaagccggtcctagaagatatttccatgaccatgccggctggtaaggtatatgctttggccggcgagtcagggcaggggaaaacgaccttggcccagctgctcttgggacgcttgcgggcggataagggagctatttacttgggtgagcaggagatttcaggtatcagtaagctttctctgaatgagcaggtcctctatgtgtcgggccagtcaaccttgcttaaccagtctatctaccataacttgcggatggcttgtgactggtccaaggaggacatcttggcttgggcagatcagcatggggtcttgcagtttgtcaagaatctgccagacggtttggatacgattgtgggtgatgacggtgctttcttgtcgcctggtcaacgccagcaggttatctgtgcccgtgcggtcttggctaaacgctccctttatatctttgacgaggtgacgtccagcgtcgatcaggacaatgaaggcttgatttacgacctcattgacttggtggccaaggatgcgattgtcatcatcataacccataagatgaaacaggtggagcaggcagatgacatcctcttcctgtctgcggagggagctgtgacaggcaactatgccacgctttatcagactagcttggcttacggtcaactggtcgatcaacaaagagaattggaggaagcagtttatggataagaaagaaatgccaacacgagtgctgattccgagactcttgcagtccatgaagcacctcttgccacggattgcggttgcggtttgctttgcggtcttgggacaggtggtgaccattgctattccagttatgctggtctatctggctttcaatgcccttactggcaatcctgctccgctatggaccttgggaatcctcattctcctagctcttttacgtggtgccttccgctatggtgagcattactttggtcattatgtggcctttcatacgctggcggcttaccgtcgcttgattttcgcaaaattgcgggccttggctcctgggaaattggaccggcaggacagcggtagcctgcttaagatgattggggaggatattgaggccttggaggttttctttgcccataccattgccccgatttgtacagggattttggtggctcttggtttgacggtctattttggtctatctagttggggtttggcttttctggctctggtgacctatgctcttttagcgattgctattccaaatcagtttgctcagcagttacaacccttgctcaaggagcaaaatgctagccgtaagggctatgtgtcctactttattgaaagtcttaagagcatgaaggatctcatgcagttccagcagacagatgctcgcttcgccaatctgactcagaaaagccaagaggtcaatggtcaggagagaagggtcgcccagaccaacttcatgcagtatgccgtctccttcttggtggtcggcttgtctatcatgggctttgcctggctgaccttcgacttggtgggtagtcagagtttggacttagcaacaggagtagccctgctggtttctttcattagctcctttgctcccttcttggaactcagccgtctgcctcttggtttcaagcgggctatgaatgctggtcgcaacatctatgctcttttggatgaaaaagaagcagagcgaacaggtgagcttgttgaggtcagcgtgacagacattgctattgagcaactggacttcgactatgatgtccgagaaacaggcctttatcgtaacctgtctgtccagtttgaacagggaggcatcattggtctggttggtgagtctggtgcaggaaaatccaccttgatgaaactaattatgcggtggtatgattggcagcaaggccaaatccgcctgtctggcttggatagtcggcaggtagataaggctcatttgcagggggcttttgcctatgtaccacaggtgccacaaatcttccgccagaccattcgggaaaatcttgtcttgggtcgtacggatatatcggatgaaaccatcatggacttggcagaaaaatgccatatgaaagaacggattttggcagcaccgcagggcttggatacgcttgtggaggccagtgatttttcagcaggagaggggcaacgcttggaactcatgcgggccctgctcaaaaatgcggattgctatatctttgatgagccaactagtaacctagattcgctcaatgaagcccgctttatccaactggttaaggaacactgccagggcatggtcttcttgatttctcatagaagctcgaccatggcttgtgcggataccattttccgcttggaagacggacaattagtaaaggaaaaataaatgaagaaattacaagtaaaagatctgatggtaacaggggcttttgctgccctctactttgtttgtgttggtctaggaaccttgttgagcttggtttttgatcgttcgggtaatatgatgtatgcacctgcgggagcagcccttttggcaggacctgtttatatgttattggtagccaaggttggtaaatttggttcaattagtctggttggagcagtaatggcctgtttctttttcctatcaggctatatgacagcggcctttctcccaagtttgacctttggttttttggcagaaatggtagcgaagtcaggtcactataaacaaaaatggaccaatctttttagctatatcattttctcttttggaaacttaggacctattattcttatgtggttcatgcgagatgcctatgaggccaatcttttggcacgtggaaaatcagcagaatacatcgctcgtgtcatgcttgatttcactccagagaatgtgctatggttgtcaacgaccattatcttaacagctcttatcagtggtttgtttggtcaatatatgcttcagcgctattttaaacaatcaggttatctttcatgaaattagatgctcgtacaaaaattattctcgtcatcttcactagttttacctatgggatgaggcttacaatattagaaaatgcagtgctggtcttaggccttagcctgcttttctggttttctggaaagcggaaaatggctataatgagtccgatagcctattctattttttgtctgttgtcctatattacatttttaccagcatggctgacgcatttgttacttgtattgacctatacatggcctccgcttttggcaggacatctattactgatgacgacaagtggttacgaactcattcatggcttgcggaaatggcacctgccagaggtatttcttttgacgttgggagtaatgtttcgtttcctacctgccattaaacaggatgctcgtacgatttgtgcctctttgaaggttagaggaatttttttacggaagagagatgtggtttgtaagccactccagtacatggagtttttcttggttcccttgatgatgtctctcttgcgaacagctcaggaattgacagtagccagtctgacaaaaggtttggctgtgtctacgaaatcacctgcatatatttggtcgtcttggaccgtgctagattggagtctttgtttatgttgtctcggttttctgattctcgtccggctgtgacggtaaaaaatgtagcattaacttattcaggagcagataaaccagccttgcagatagaggatctgaccattccagaaggacagtgtgttgttttatgtgggcagagtggttctgggaagtctagttttctcaaggtattaaatggtttgacgccagaatattatcctgctcagctttcgggacaaattttcttaggggacttggatttacaaaaatctagtctggaagaaatatctcggcacattgcttcagtctttcagcatccgtctactcaattttttcatagtcaggtcttgcaggaattggttttcccttgtgaaaatcagggtttgtcaagagaagaaatcgagaatcgcctggcttgggttatggaattatttggtttggcttctcttagccagcgaacgatttccagtctatcaggtggtcagcaacaacgtctagccttggccgttgcaactatgcaagggacagatgtcttggttttagatgagccgactgccaacctagatcaggaagggattgtgattgtagaggacatcttgaaaactttaaaaagccaaggcaagaccattattattgccgagcatagactgtcttatctcagtcaattggcagatcgctatttatattttcaagatgggcaagtggtgacggattatctagcagatgagtttttaagtcggacagaagaatgccgtcaggatatgggactgcgttgttatgactcggagccttatgggcgggcaatagcggagctggcagaccagtttgttaatgataaagaggggttacttgttgaaaatttatcggtaagtcagaaagagaatactctctacgagattgaaaaactctgcttggcaccaggacaggtggtgggtttggttggagcgaatggttctggaaaaacaagccttgctcgttatctggtcggtttagcggaagataagaagagtaggatttcttggcaaggtcaaaccttatctagtcgccagagattggaaaaaacagcctttgttatgcaggatgttcgactccaactatttgcggaaagtgttgagcgagaacttactcttggaaggaaaaatagagctgtcgatgaacatttggtggctcgttttggtctatcggatttgttggagagacatccggtcagtttatcgggtggtgaacaacagcgcgtgatgatagtagctagcttactggcagataaggaaattttcatttttgatgaaccgacgagcggcttggatttgagacgaatgcaacaagttgcttccgctttagtagacttaaaaatgaagaataagttggttttgttaatttctcacgatgaagagctattgaatctggtttgtgataaaatagtagatattaaacagttgaaatagtgattatgaacaaacaaacctataaagaaattttaaccattgcctttccagccatgggggaaaaccttctccagatgttaatgggggtagtagactcttatctagtagccagtattggcattgtagctttgtctggagtttcccttgctaataatattttagccgtctatcaggcggtttttattgccctagcagtagcggtgtcttctcgtttggctcaggctttgggtgaagggggttcagaaggcattggaggaactgctagtgaaagtgtcaagtttacagtttttatcggtctccttttaggaattttttcagttctggcaggtccaatagtacttactagcttgggggcagagtcagaagtggtacaggctgggggtctttatttgatattggttggtgggggagcaccttttttgggactcatgacaagtttgagtgcaatcttacgaaccttgggggaaccacgttttcctatgtatatcagtctgctctcaaacgttctaaatgcactattttcagcatttgcagtctttgtgcttcatgcaggtgtagctggagttgcgattggcacggtattatcgcggttgattggttgtagcctgctttggtctcgcttaccaatttctttaaaaccatggacctggtcctttgataaagaactgcttagacttgccctgccagcaactggtgaacggttgatgatgcgggtgggagatgtggtagtcgtggcgttgattaccagcttaggaacagcgacggtagctggaaatgcgattggagaaaccctgacgcagtttaactatatgccggctttagggattgctaccgcaacaatcatccttacagcgaaacacagacaggataaggctatggttcgacatatttttcgaacaagctttggcctttctttgctgtttatgtttttggtggctggtgtgacttattttgcggggtctttcctaatcgacctttatactaaggatattcaagcagcacaagctagtcaaacagtattattttatgccatgttgggagttccctttacagctggcactcttattatgacagctctttggcaaggtttgggaaatgctagattacccttttatgccacaactatcggtatgtggctagtgcggattggcatagcttatttacttgtaacattttttaaaatcggtttgtcagccatttggattgcaacgattttagataatgccttccgatcaggggtgctattttttcagtataggtattcaaaacaagaatcaatttaagataaggctaagaaaattttcagtttcttttaagtttgtagctatatactatattcaagctagaaatagcgaacaactttctttttcatataatctcctagagaacagtcggccgcggtcggctgttttcgtgtgttctattcttatgtaaaaatggtataatagtagtgattgtgtaaggagaaaagtatgtcggtagtaggaaaagcaaatggaaaaatcattttgatgggagagcatgcggtggtctatgggcacccagcaattgctatgcctttttctgctgttgaaattattgctcaggtaactgctcaaggggaagcgctgactgttgcttgtgacttctataaaggcttagttcacaagatgccaaaaatctgggaaagcctcaagcatgccatccgtttctcgctctatcgtatcggagcgccgacagacccagctattcatatcgagattagttccaccattcctgccgagcgtggcatgggctccagtgcagccgtggcagttgcagtagcacgcgccctctttgcctattatgaaaaagagctgaccgacagcgaactctgggacatcgtccagtcttcggaaaaaattgctcacggcaatccctcgggtattgatgcggcgaccaccagcggcaagtcccccgtcttctttatcaagcaccagcccatcgaaccttttgagctgaaactccatgcccatttggtagtggctgacacaggtgtgacgggaaataccttagaagccatttcagacgtggcagatttgttggagaaaaagccagaggctatcaagctagtagaagaactggggaacttgacccgacaggccaaggaagatttagccacagaccaggcagagcttctaggcagcagaatgaaccaagctcatgccctcctgcaaaaattaggcgtgtctgatcctagcctagataagctagtcagccttgcccaagaaaatggagccctcggagccaaattaactggtggcggacgaggcggttgcatgattgccctggcaagaacagctcaggatgcccaaaaacttgcacacatccttgaccaagcaggcgcccgccaaacctggatacagtacttaggagaaaccaatgactaaacaaataggcatagcccgtgcccataccaatattgccttgattaaatactggggaaaacgcgataaggaattattcctacctatgaattccagtttatccctgacccttgacgcattttatacggataccaaggtcgtttttgacccagaattaactgctgatgagttctatctcaatgggattttacaaaaagaaaaagaaattttaaaaatttctcgatttttggatttattttgcgaatatataggtgaaagggcatttgcccgagtggaaagtctaaattttgttccgactgcagctggtttggcaagctcagcatcagccttcgcagcgcttgcgcttgcaaccgcaactgccttggatttagatttgtcaccagccaccctatcaacccttgctcgcaggggttctggctctagtacccgtagcctattcggtggatttgttgagtggggcatgggaactggttcggaagattcgatggctcatcccattgatgatgcggattgggatatcggcatggtcgtcttggcggtcaataccggaccgaaaaagattgctagtcgagagggaatggaccacacagttgccacctcaccattttacacagcctgggtagaaaccgctaagcaagacttggtggacatcaaggcagctattgccagccgtgattttgaaaaacttggtcagattacagagcacaatggcatgaaaatgcatgcaacaacgctctctgccaatccaccctttacctattggtcagccgatagcctagtggctcaagaggcagtccgtcaggttcgtgaagcaactggcttatcagcctacatgaccatggatgcaggaccaaatgtcaaggtcctctgtcgagcaagtcagatggatgagctagtagctggattggccaaagtcttcccaagagagaaaatcatcaccagcaagcctggacctgctgcttatgttctcagtgagaaggattggcaggcatcacaaacagcatttgaaaagggaatctagcatgaaagtgcaagtaaagataccaggaaaactctttctggcaggggaatatgcagttgttgaagctggctatcctgcggtgattgcggcggttggccagtacctaaccgtcaccattgaaacaagtgaccaaggcagtcttcattctagtcaaaaggcagacctttatctgacctgggagcgtaaggaaggtgccgttcgtattcaaggtagccatccctatgccttgattgaatcagctatgcaggtgacagaagcctatctgacggccaagggctatgcttgtcatggaacctatagcctatctgtacagtccgacctagatgaccaagcctctggtgccaagtacggtctggggtcttcaggagcagtaacggttgcgacggtcaaggccctgttgacctattacggtcatcaagcggatgcccttttgacctacaagctagcagctctgacccagtccaagctaggcatgacaggttcctttggagatttggcggcttccagttttggcggcttgatagcctatcattccctggaccgttcttggcttttagggaaaatggcagagctgtctctgctggatgtggtggaaagtgattggcaaagtttgtctatcagccctatccagttaccccaaggtctagacctcttggttggttggacagggtcggcggcttcaacggatagtctagtttcccagatggaaagccaaaaaagtcagacagaaaaagagcaaattcatagccagtttttagccgactccaagacttgtgtagagcagttgatagtggcctgtcagacaaatgattcagtatcagctagacaggccttgtcagctaatcgcaagctcttacaggactttgcgagaggaatgggcttggtcattgaaacgcctcaactgagtcaactctgtgatctggcccaaacttatggagcggtggccaaatcatctggtgctggcggaggtgactgcggtatttgcttggtagacagtaaggaacaaaaagcagcgatagagacggcttggcaagaagccggtatttttccactcaccctaaacatcgcaagtagagaataaggagaaccctatgttttatctaggagaatttggtttagatcgcaaggatcaacacgttggcttggccaatcagcaatatagtgccacgccggccaaggactttacagaaactctgtttgtccatcattccctgccgcagaccaaggtggatgaagtggatatttcgaccagtgtagctggtttggactttgcctttcctttcttcatcaatgccatgactggtggaagcaagaagacccgggaaatcaaccgtctgttgggaattatggggcattttggcaagattgccctggcttctggttcggtcagtgcggcaatcaaggatccgtctgttgcggaaaccttctctgttatgcgtcgggaaaatccttacgggataatctttgccaacctaggtgcccatcatagtgtggaaaatgccaagcgggcggtggatttgttggaggccaatgccattcagatccatgtcaatgctcctcaggagattgtcatgccggagggggaccgtgatttcactatgtggttgaagaatattgaaactctggtgcgggagatggaagtgcctgtcattgtcaaggaagttggttttggcatgagccgtgaaacagtagcccagctggcttctgccggcgtgcaaacaattgatgtatctggtactgggggaacggatttcgccaagattgaaaatgcccgtcggaccttcaatgactatgcctatttagaaggttggggccagtctaccgtgacttccttggtggaagctatgtctgtttctgaagaagtttgcccaagcctgattgcttctggtggcattaaaacaccgctagatattgtcaaatcattggctttaggtgcagaccttgtcggtatgtccaatcatttccttcaatatgtcaaggatggaaaagggcatcgttttgacgacggtttgcaggctattaaggtctatcaatggcagattgctgaaatcatgaccatgctgggtgctaagaatattgcggaactccggcagaaagatctggtcttggcaccaaatgtccagaactggtgtgaggcgcgtgggattgattggaaagcctatgcccgtcggtcagcgaatgtgagttaaagagagatagattgatgtcttcagttctcaacaatgtagaaaaataaaaaagccaggtccattttggaacttggcttttgtcatggagtggtttctaggttgctgttaactggcctgcttgtaactggtacatacggtggtagtgacccttgagggctagaagttcttcatgattgcctgactcgatgatctttcccttatccaagacataaatacagtcggcatcctgaatggtcgataggcggtgggcgatggcaatggttgtccgcccttttcgcattttctcaagagaagtctggactgtcttctccgtctcagaatcgatattggcggtagcctcgtctaaaatgagaatcttaggctggctagccatggtgcgtgcaaaggccagcagttgccgttgtcctgtcgaaaaggcggagccccgctcggtgaccaagtggtcgtatttctcaggaagtttttcgatgaagggagcagcgtccacaaatcgagccgcttcctcaatctcctcctgagaaatatcctgatacatctggatattggatgcaatggttccgtgaaatagaaagggatcttgcaggactaggccaatcgcggaccgcaattcttcctgcgaaaagctacgaatatcctgaccgtcaatcaaaatccgtccagattggaattcatagaaacgcataaagacattgatgatagaagatttgcctgatcctgtagcacccacaaaggcgatggtctgcccctgtctcacttcaaaggaaaccttgtccagaatttgccgcttgccgtcataggaaaagtaaacatcctcaaagacaatatgccccttgtcaatcttggcccctcggtccagctgtagtggctcctcgatggtctggtccatgagcgtaaagacccgtccggcagataccatagaggtttggagggtggaaaaatgctgcgtgacatccagcaagggatcgaaaagacgattgacatactggatgaaagcatagataagaccagcagaaattccagcctgtgaccagtccaaaccaaaataggtcatgagtagggcataggccaaaatcttaacaagtgacagggcagggcggagaaagagactgtccaaggccatggaacgactggcatagtccagatgttcctggttgatagcctcaaactcttcctttagcctctcctcttgagaaaaggcctggataatccaaatcccctcgatgctctctgccagtttgctgttgatggcactcaacagacttctagtcttggccacaatgggagctgaccgcttccgatactgatcaaccaggatgaaaatcacgggcaggaagaggacaatcagactggtcaatttccaatccagagcaaacatggtcgaaagagtcgtgacgataataaagagagctgagataaaactggataaaatccctgaaaacatctctgaaatactctccgtatcattggtgatgcgagagacaatggaaccactaggagtctggtcgaagtaagccattcccagcttttccattctcccaaaggcatcccggcgaatatctctgacaatgctgtaggaaactttagcaaaccagagatttccaaaatattgaagtaccatttgaagcagatagagggcgaagtaggcagctagaatggccacagcagtctcagaaatagtagaaatgtagtggtcgataaaataagaggctagaaggggaattagactgcggaccacggtagtcagtagcaaaaagctcaaggcaaggactgtcagcagtcgataggctttgagataggacaagagtcgcaaaaaaacactagcttgcttggttttagagagcatcactttcctccttttcgagttgctgcatcatataggtatcgtagtaccagcctttttcatctagtaattcttggtgacgacctcgttctacgatttttccatcttcaaggaccagaatcaaatcggcatggacaatagctgacaggcgatgggcggtgataatggtggttttgtcaaggcgttcttgcttgatggtttcgagaatagcgtgttctgttttagcatccaccgctgagagcgagtcatccaagagcaggatatctggattgagaatcatggcacgggccatagccaaccgttgtttttgtccgccagaaagggaaatccccttttcgccgaccatggtttcaaagcggtcgggcatatcctgaatatcctcatagacatggacagcccgagcggcctcttctacctgatttagagataaatcgggattgccgaagcggatgttttcagtaatgctggtcgcaaagaggaactggtcctggggtacatagccaattaagcgtcgcaggtcagctagcttgtagttcttgatattttcttgattgagcaagatctgtccatttatcacatcgtattctcgcatcaggagcttgagcaggcttgttttcccagaacctgttagccccacaagaccaattgtctgcccttttttgatctgaaactggatgtcttggaggactggtatgttatcataggcaaattcgctaatctcatagacaagctctccattgcttggtgcaggcagcggttggtctgtttcaatgacctctgaggaaatgctgagaagggtctgaatccgattgtaagatacatcaccacgctggctaatattgaccaaaaaaccaatcgccataagaggccagacgaggagatctaaataggtcatgaaagttactagttggcccagactgacctgaccttgcgagatgaagtgagagccgaccagaagggtcagcaggtaggacaggccaatgaagaagaggacggcagggttgaacagggcatcgtaacgcatggttttgatattctgcaagaaggctgcttggttgacttcctgaaaagccgccgtttcttgttcttggtagccaaaggatttagtaacctttataccagaaacagcttcctggaccttgttgttaagctctgaaaaggctgcctgtgaagccttgaaattttcatgagtgcgacggcctaaaaaattagtggttagagtcatgaagggtagggggaggattgcaaccaaggtcatctgccaggaaatgctcaaactcatcgtaattagggtaaccaaggctgtgaccgttgcatcaacaaaagacatgacgccaccacctgctagtcgggtcagggcattgatatcattggttgcgtgggccattaaatccccagtccgatgttgctgaaaaaaggatggagataggtgcataaagtggtcaaacagccgagccctcatgatttttcctagacgataagatgttgccaggatgttcattcgccaaagatagcggaggccgtacatggccaaggctgacaagatgagcccagctaccccgagtagcaagcgatgctcagtcaactgtccgctggcaatctggtcaatcaactgccccatgatagaagcgggaaggagattgaggaggctgaccaaacagagtgataaaatcccaatcagataggcctttttctcaagggaaaagaaccaccacaattgcttgataatcttcataaatgtcctttctgaacaaaagaaaggttggtagcttgtcgcaaccaacaaataatagaattcggtgacactagtgtatcacagactggtagaaatagaaagtttgtaacttaaaaattaggcaactctagccgtagccgaatagaagaaacagttggagttgtaaacacgtacgatacaggtagaaatcaaaagatttttacctttttctgtctatttatgataaaatatatgaaaatttagaagaggtgttcagatgaaagctattgttacagttgtcggtaaggacaagtcaggaattgttgcgggtgttgcgaccaagattgcggagttagggctcaatatcgatgatatttcacaaactgttttggatgagtattttaccatgatggcggtggtgtcgtcagatgagaagaaagatttcaccaagcttcgtgcagaactagaagcctatggtcaggctttgaatgtgaaaatcaacattcaaagtgcagccatttttgatgctatgcacaacttgtaaggagagatttcatggatattagacaggttagagaaaccattgaaatgattgaggagcagaatttcgatattcggaccatcaccatggggatttccctcttggactgtatcgactcggatatcgacaaggctgcggagaaagtgtataccaagattgtcaccaaggccaagaacttggtagcagtcggcgatgagattgcggcagaactaggcattcccattgtcaacaaacgggtgtcagtaacgcctattgctttgattggtgcggcgacggatgccacggattaccttcccctagctcatgccttggacaaggcggctcatgagatcggcatcgattttatcggtggtttttcagctcttgctcaaaagggctaccaaaaaggtgatgaaatcctcatcaactctattccgcaggcattggcccaaacctctaaggtctgctcgtcagtcaatatcggctcgaccaagacgggtatcaatatgacggctgtgcgggacatggggcggatcattaaggagacggcggaggcttctgatatgggggctgccaagttggtggtctttgccaatgcggttgaggacaatcctttcatggcgggggccttccacggtgtcggcgaggcggatgtggtcatcaatgtcggcgtgtctgggcctggtgtggtcaagcgtgcccttgaaaaagtgcgtggtgagagctttgatgtggtggcggagaccgtcaagaagacggctttcaagattacccgtatcggtcagttggtcggcaatatggccagtgaacgcctgggggttaagttcggtatcgtggacctgtcgcttgctccaacaccagctgttggcgactcagtagcacgggttttggaggaaatgggcttagaaaccgttggtacgcacggaacgactgctgccctggctttgctcaatgacgcagtcaaaaagggtggggtcatggcctgcaaccaagtcggtggcttgtcaggtgcctttatccctgtgtctgaggatgagggcatgattgcggcggtgcaaaatggctcgctcaaccttgaaaaattggaagccatgacggctatctgttctgtaggtttggacatgattgccattccagaaacaacgcctgctgaaaccattgcggctatgattgcggatgaagcggctattggggttatcaatcagaaaacaactgcggttcgtattattccgcttggaaaagaaggagacatgattgaatttggcggccttctgggaacagctcctgttatgaaggtcaatcaagcttcgtctgtggactttatcaaccgtggtggtcagattccagcaccgattcatagctttaagaactaaaaaacgtagaccgattgccacaagcagtcggttttttgttatactaatagtaagaaatgacaaggagaaaaacgaatggcagatgtaagattatatatttctcgtcacgggaaaaccatgttcaataccattgggcgcgtgcagggctggtgtgatacgccgctgaccaaggtcggtgaggaaggaattcgtgaactgggcttggggctcaaggatgcgggccttgactttaaactagccgtatccagtgatctgggtcgaaccgttcagaccatgaccatcgcccagcgtgagttaggaattttagggaaaatcccttattaccaagacaagcgtatccgtgaatggtgtttcggtagttttgaaggcatgtacgatgccgagcttttccaaggggtcctgcctcgtttgaaagggacagttgatgcgacgggtatgtcctttgcggaaatcgcagcaggtatccaagaagcagacaccgctggctgggcggaatcgtgggaggttttgagcaaccgtatcttgacaggttttgaatccatcgcccaggacttggaaaaacaaggcggaggcaatgcccttgtggtcagccacggtatgactattgcgacattggctcatttgttagagccagagcgtggtgccaatgtctttctcgataacggctcaatcaccgtcctcaaatacgaaaatggcaagcttttaattgaagcagttggggatttatcctaccgcaaacgtggggcagagttgattgcccaagggaaataagatataaaatcagggaggattctctgattttttttcttgacatccaccattctaggtcctcagactgatttttagcactctaagcaaaagagtgctaattttttgtctttttctcttgacaatccattttttcggcgtataatgggagtataagtaattagcactcgatatcatagagtgctaacgctcttcaaaaatcaacactatccgttgtcagcttgcctttgtgaaccatagttctacattcggcctcgcttcctaggctactgtcgattttcgctgagcgtaactaaaacagtgttcatgaaaggagcggagatgattacccaacgtcaaaatgatattttgaatctgattgttgaattatttacgcgccatcatgagccagttggttctaaggccttgcaggaaatgattgcttcaagttcggctaccattcgtaatgacatggccaagctagagcagttgggtttgctggaaaaggcccacacatcaagtggtcgtatgcccagtcgggctggttttcaatactttgtcaaccactcgctcaatctgaaacacatcaatgaagaagatgtttatcaagtggttaaggcctttgactttgaagccttcaagctagaggacatcttggagcgagcaagtcaggtcctagcggatttgacaggctacacctcggtcattttagatgtggagccgaccagtcagcagctgacttcctttgacattgtgcagctcagtagccacgatgctctggcagtcttgactctggaccagtccaaacctgtcactgttcagtttgctattcctaagaacttcttgactagggatttggaagtgctcaaacgcttagttgatgagcgcttcgttgggcagacggtcttggcaatccactacaagttgcggacggagattccccaagtggtgcagcgttactttgccacgacggacaatgtcttggatctcatggactacatcttttccaatcttttccaagaatcggtctttatcagtggaaaagttgcctcgctgacctacggcaatcttgccacctaccaactcttggatagtcctcagttattggcaccagagttgcggcagggcttggctcccaaccagcagaccagcatttccgtggcggaacatagagaacctgctcttgcagatgtgacggtcattcatcatcgttttccaatcccctatcggggcatgggccagatgagtttgctcggtcctgttgacatggactaccgtaggcagatgagcttaatcaacatcatcagccgcatcctatttatgaaattaaccgattactaccgttatctaagtagtaatcattacgaagtcaattagaaggagaatgctttgtcagaagaaatcaaaaacgaagaaatcgtagaagaggttgaagcaacagaagaagttgtggagacacctgaaaaatcagaattggatttggcaaacgagcgcgctgaggaatttgaaaacaagtaccttcgtgcccacgctgaaatgcaaaatatccaacgccgtgcaaacgaagaacgccaaaccattcagcgttaccgttcgcaagacttggccaagaaaatcttgccgagcttggataacttggaacgtgcccttcaagtcgaaggcttgacagaagatgtcaaaaaaggcttggaaatggttcaagaaagcttgattcaagcccttaaagaagaaggggtggaagaagtcgcaacagatgtctttgacccaaatcttcacatggccattcaaacagtcccagccacagacgattgcccagcagaacacatcgcacaagtcttccaaaaaggctacaagctgcatgaacgcttgctgagaccggctatggtagtggtgtcggaatagtcgctctgctatttcccaaaaaagaaaacctgaccgaaatgtcattaaactaggctaaattgaacataaaaagtaaattaaaaagaggtaacacatatgtctaaaattatcggtattgacttaggtacaacaaactcagcagttgcagttcttgaaggaactgaatcaaaaatcattgcaaacccagaaggaaaccgcacaactccgtctgttgtgtctttcaaaaatggtgaaatcatcgttggtgacgcggcaaaacgccaagcggtaaccaacccagataccatcatctctatcaaatcaaaaatgggaacttctgaaaaagtttcagcaaacggtaaagaatacacaccacaagaaatctcagcaatgattcttcaatacttgaaaggttacgctgaagaatatcttggtgaaaaagtaaccaaagcggttatcactgttcctgcttacttcaacgatgcccaacgtcaagcaaccaaagacgctggtaaaatcgctggtcttgaagtagaacgtatcgtcaatgaaccaactgcagcagctcttgcttacggtttggacaagactgacaaagatgaaaaaatcttggtattcgaccttggtggcggtacattcgacgtatctatccttgaacttggtgacggtgtctttgacgtacttgcaacagcaggtgataacaagctcggtggtgacgactttgaccaaaagattatcgaccacatggtagcagagttcaagaaagaaaacggtatcgacttgtcagctgacaaaatggcccttcaacgtttgaaagatgcagctgaaaaagctaagaaagacttgtcaggcgtgacttcaactcaaatcagcttgccattcatcactgcaggtgcagcaggtccacttcacttggaaatgacattgactcgtgcgaaatttgacgaattgacttacgaccttgtagaacgtacaaaaattcctgttcgtcaagccctttcagatgcaggtctcagcctatcagaaatcgatgaagtaatccttgtcggtggttcaactcgtatcccagccgttgtggaagctgtaaaagctgaaactggtaaagagccaaacaaatctgtaaaccctgacgaagtggttgccatgggtgcggcaatccaaggtggtgtgattactggtgatgtcaaagatgttgttcttcttgacgtaacaccattgtcacttggtatcgaaacaatgggtggtgtatttacaaaactcatcgaccgtaacacaacaatcccaacttctaaatcacaagttttctcaactgcagcggacaaccagccagctgttgacatccacgtgcttcaaggtgagcgtccaatggcagcggacaacaagactcttggtcgtttccaattgacagacatccctgcagcacctcgtggtattccacaaatcgaagtaacattcgacatcgacaagaacggtatcgtttctgtaaaagccaaagaccttggtacacaaaaagaacaaactatcgttatccagtctaactcaggtttgacagatgaagaaatcgaccgcatgatgaaagatgcagaagctaacgcggaagcagataagaaacgtaaggaagaagtggaccttcgtaacgatgttgaccaagcaatctttgcgactgagaaaactcttaaggaaacagaaggcaaaggcttcgacgcagaacgtgaccaagcccaagctgctcttgatgagttgaaagcagctcaggaagctaacaacttggacgacatgaaggctaaacttgaaaacctcaacgaaaaagcccaagcccttgcagtgaaactctacgagcaagccgcagcagcacaacaagcagccgcaggccaagaaggtgcccaaacagctaacaatgcagatgatgatgtggtagatggcgagtttactgaaaagtagtactcttcgaaattcttcactaggcttcgttaactctcctcgatgaactccagttcaatcttcgtccagttgcctagcctagtcttgaatttctttgagtatctagaacaaggaaagttatcttttttccgtagttcttagcttgaactcagttctcctcttcccgagaatagaaattattagttaataaagattccaatcacagaggttgcaacccagcctctgtttttgggtaaatacccgtctaacttttacagaaaggaaagtgttcgtaactgaacacgggctactttctgagtttcgtctattatttaacgaaaggaaatgaactcgccctaaaagctgtgtgaaaaagataaatcgtctagaaaatcaggattttctgccgatttcctattttcactttgcttttaacgggcttggtatcttatatgaacaatactgaattttacgatcgtcttggtgtttctaagaatgcttcgccagacgagattaagaaggcttatcggaagctttcaaagaaataccatccagatattaacaaggatccgggtgcggaggataaatacaaggaggtccaggaggcttatgagaccttgagcgacccgcaaaaacggtctgcctatgaccagtatggtcctgctggtgctaatggaggcttcggcggaggagcaggtggctttggtggtttcgacggagcaggtttcggtggctttgaagacattttctctagtttctttggtggaggtggtgcgacgcgcaatcctaatgcacctcgtcaaggggatgatttgcaatatgcggtcaatttgaaatttgaagaagcgatttttggtgtggaacgagaagtttcctacaatcgtgaagcaacttgtcgaacctgtacaggttcaggtgccaaacctggaacaagtccggtaacctgtgggcgttgtcatggttctggagtgatcaatgtggacacccaaactccacttggaaccatgcgtcgtcaaatgacctgtgatgtctgtcatggtcgcggaaaacaaatcaaagacccatgtacaacctgtcatggaactggtcatgaaaaacaagcccatacggtaacggttaaggtgccagctggtgtggaaactggtcaacgtattcgcttggctggtcaaggtgaagctggtttcaatggaggtccatacggagatctctacgttgtcattcaggtccaaccttcagacaagtttgaacgtgaagggaccaccattcactataaactgaacctcaactttgtccaagcagcacttggagatactgttcatgtgccaacagttcacggtgatgtggatatggtcattcctgaaggtacccagactggtaagaccttccgactcaaaggaaaaggtgcaccaagtgttcgtggtggagctattggtgatcaatatgtcacagtaaatatcgtcactccgacaggtttgaatgaccgccaaaaagcagctcttaaagaatttgcggcagctggaaatattgatgtcaaaccccataaaaaaggattttttgacaaggtaaaatatgcctttgaggatttataattctaagatgagactgggcaaaaagcccaggaccactactcagagttcgtttcaacatctcagcgcagtggttgattggcagatttgttcgtgttttgcactccaaatctggcctaatcaactgtgcgggggtgggaagacgaactctttttatcttggtcgagttctttcccactcccctttctttttcagaaaaaactctgggcattttctccgacgcatcacaggctctgtgttaaaataagatatagtaatttgaaagagaacgcttacgaatgaaatcttgggttgagaatgtgaccataaagaaatacgaagatcggtctggcttgacgggtttgaaacaggagccactggtgtggactgaggtctttttgcgcgaggtcaatcgtcagtccaatacaggaattttacatttttggcccatggaccaaacggtcattctggggatgatggatagtcaggttgcccagctggacaagggcttagccagtattggtcaggcaggctacagtcctattattcggagtttgggcggtttggcagtcgttgcagatgaagggattttaaatgtcactctgattttgtccaatccttctggtcacaaggttgatttgcgggagtcttatcaggtcatggtggatttgattgcccaggcactttcagattttccctttgaggttgtcagtggtgaggtggcaacttcctactgtccagggacctacgaccttagtatcaaggggcggaagtttgctggattggcccagcggatttaccaagaggctattgccatttctgcctatatcagtgtgtcaggtaatcaagtcaaacgtgggcaagtggtggcggatttttatgtggcaagttttgctccgcaagaagtatcggacagatttccgcaagtaaatccggattcgatggccaatctgtcagacttggtcggtcaggatgtgacggtggaggatatgaagaaacggattgagcaagtattggttgaaaatgggaccaggctgtctactttttatccctcgtcggacaacatggctgattttatgacctttggaaagaccatcaagcagtctatggaaaaatatggtatctaggagattcttatgatatggaaagatgcgacagccatggctcaggctgtcaatcaaaaacaggtttttgccaaggaattggtgcaagaaacgattgacaggattgaaaagctcaatcccaccctcaatgcggttgtcagcaagcagtatgaagaagccttgaaagaagcggagaaagaagactatctgggcaagccatttgctggagttcctttcttgttgaaggatctggggcaaaatgaaaaggggcagccatcttctgctggttctcgcctacttgctggtcgaccagcaggccataccgacacctatgtccaacgcttgaaagatttgggtttcatcatagtcggtcgaaccaatacgccagaattcggcttcaaaaatatctcagacgccagcctgcatggtcctgtcaatcttcccttggaccccagtcgcaatgctggtggatcaagtggtggtgcagctgcagcactggcttcaggcatggtctctattgctgcagcatcggatggtggtgggtctattcgcatcccagcctccttcaatggcttgatcgggctcaaaaccagtcgtggtcggattccagttggacctaagtcttatcgtggctggcagggagcatctgtcaattttgccctgaccaagtctgtccgtgacacccagcgtctgctctatcattttcaggactaccagctggaagctccttttccccttgccaagctgagtgaagaggaggtttttggaaaattgtctcgccccctaaaaatcgcctactataccaaatctccagtagggagcaaggtcagtcttgaagcggtagaagcggttcaaaaagcctgtcatcacttggcaaatttggggcatgaagtggtggaattaacagaatatcctctggatggagtggccctgatgaaatccttctacctgatgaacagcgtggacacggcccagatgtttgacgaaatcgaagcagcttttgggcgccagatgaccttggatgacatggaagtcatgtcctgggctatttaccaaagcgggcaaactattccagccaaattgtactccaaggccctattggactgggaccagtttggagccagcatggcgcgtttccatgaggaatacgacttgctcctgacgccgacagtggctgatgtagcgcccaagcatggacaatttgacctaccagtagatttgctggatcgcctcaagcagacccagaactattccatggaagagcagcaggacctgatctggcaaatgttcgaggacagtctggccttaactccctttacgcagcaggccaatatttgtggtcagccagctatttctctgccaacttatgtacgtgctgacagcctgccaatcggcgttcaattgacagcatccaagggacgagaggatttgctcttgcagttggcagatcaaatggaggcagctggtttactcaacttgtaagggaattcattttttcagttcaattatttgccaaaacgttttcaaaatgttaacctgtaaaagttggtgggttaacaccgaaaaagtaaaaaaggaagctatggcttccaaaggagattgttttatgttgaaaaaagttttagcctcagctctcttggtttctacattgaccttggcagcatgttctagttcaagttcgaatactagcagttcttctgctgaacagactcaatgggaaaaaattcaagaagctggtgtcttgaaagttgctacaccaggtaccctcttcccaacttcttactacaatgatgctaaagaattggtcggatatgaaattgacatgatcaatgaaattggtaagcgtttgaaactggaaattgaataccaagaaatcggtgtggcagaagcctttacagcggttgacagtggtaaggtagatatttctgttaacaactttgacatgacagaagcacgtaaggaaaagtacaacttctctatcccttacaagtattcagttggtggctacattgttcgtgaagatggttcatcaggaatcgaagcagctgacttgagcgactggactggcaagaaagctggtggtggcgctggtactcagtacatgaaaatcgctgaaaagcaaggtgcagagccagttatctatgacaatgtaaccaacgatgtctatttgcgtgatgtatctacaggtcgtacagacttcattccaaatgattactatacacaagtgatggctatcaaatgggcaaatgccaacttcccagacatcaaggtaaaaatgggtgaggctaaatacaacccaactgaacaaggtattgttatgagcaaggctgacacaagcttgaaagaaaaaattgacgaagcacttgaagcgatgaaagctgatggaactttgaaggcaatttctgagaaatactatgcaggacaagacttgacagtccctgttgaaaatgctgataaattgccagttatcgaagttgaataagacctcgtaacaaattaaatgcatcttgtatagactttgtcagtcacagactggcaaggtctatctggtttttaggaaagaggagaagatatggatattaactggcaggcagtttttaatgcagatattgcaagagaggctattccacagattttggagggacttccctacactctatccctatccctaattggttttgccttggggactttctgtggattttttgtagccctcatgcggatgtctaagtttggacccttgcgttggttggctatggcccatatttctctcatgcgtggaattcccctcatggttcttctctttttcatctattttggattgcctttcatggggctacaactagatgctatctccgcatctattatcgcctttacctccatgtccagtgcctacatttctgaaattattcgtgcatctctttcggccattgataagggacaatgggaggcagcgcgttccctgggcttgcggaccaatgtgattcacagaaaaatcattattccccaagcctttcggattgctcttccaccactgagcaatgttctcttggatatggtgaaaagtacgtccttgaccgctatgattactgtaccagagattttcaataaggcaaaaatagtcggtggagctaagtcggattatatgacggtttatatctgtgtagccctcatttattgggttatctgtaccctttatgcatttggtcagctcaagctagaaaaacgcttggcgacttactaaaaagaggttggtttagccttccgattaaaatttgaacaatcaaaaatagcttagaattaacgtctcgaatgatgtggacctaagctattttttattttaaagactgttttttcgatgtaactctcactcttccacatattccaaaatatcccctggttggcagtctaagatgcggcagatgctcatcagggtattaaaacgaatgccttttgccttgcctgtcttgagaatggacagattggcttcggtgatgccgacttgctccgccaagtccttggaagtcatttgtcggtctttgaggaccttgtctaagtttacgcgaatcatttccatatcagataaactcgctgttctcggtttcaagttgttgccccttttgtactaaggtccagacaaaataagtcaagaagataaagagggcgttgaggatgaaatctgaccaacgcagattgaggaagttgtttggtccagcagcatttgtcaaggtgatcaagctggttaggcaaaattgcccagcagtcaggacgagcaaactgatgaagagcttctgataaagttccatactagctgaagcgaaataatcttcttccagaagcaatttacataacttttgaatcaagtgggcaatgtgactgagtgctactaagacaactagaatcaatccagtcgctagcagaatgagccagacactgatctggtcaatgggtttgttaaaggtgtattcccaagagcctatcgcaaaggagtcgcctccaagaccagccaggctaaagaaaatatagcttgcaattaataaatagaagaaatagcgaacacaagcagccacaatgccagctgttttgagtagattggttttcatagcaaacctccgattattattgttttatgataatattatctgtaaaattattataaaacaataatttttgaaatgcaagcgtttttttaaaaaaagaataataagaaaaccgccaactacctggcggtttgaagctatttaaaatacaatagtctcaacccattcaaaatcaccaaaatcgttgatccttcgtggcccaccacaccgagtgggaggttgatagactggaagaggttggagatgataagaagggcaatgacagatagcgcaaagatgatgttctgcttgatgatgccccgcattttcttagagagacgaatggagtaaggaattctcgtcaggtcttccatgagtacgatgtcagctgactccatagcgatgtccgttccgcttcccatagcatagctgacattggcttgagccagggcgggagcgtcgttgatgccgtctccgaccatgccgacagacgcaaactcggtttgtaattcttggataacagcagccttatccgtcggcagacagttggcaatcacacggtcaataccgacctgactcgccacgtaacgagccgtcttttcttggtcacccgtcaagagaattggcgtcacgcccatttctttcaactgggcaatcagctgcttgctctcaggtttcaaactatcttccaccatgaagatcgccaccagcacatcattttggctgacatagaccagggttttcccagtgctttccgcctcatcgatctgtgccagcaagccagcagacaggggactcaccaggctgtccgccacaaatcccgccttaccgattttccagctgtcgccctcatagcctgccaccaagccttttcctgtcacgtcttctaggctttgaagggcaatagcagagctgtcagccgtataggtcatgagagcctgagcgattgggtggcttgattgtttttcaactgcctgaacaacctgcttgataagctcttcatcgccaagataggtcgcacctacaacttcaggtttaccaatggtcagggtacccgtcttatcaaagacgatggcctctagattggcgatgttgtccgcaatgtcaccgcccttgataatcatgcccttacgtgccgcacggctgatggcagaaagtgttgcgggtgaagaagaagctacgagggcacaaggagaagcgatggttaagagaatcatgcctcggtagaaggcagttaaccagtcccagcccagtgcaaaatgagcaaggaggatgaagagtggtaccaccaccaagacaaccttgacataggtatcttccatattttcaatgaaagtcgctgtttttgatttggattcttgggcgttttcaaccatctggacgattttatcgaagagggcatcgcctttttcagccgtaacttgtacggtcacagttggaccttggttaatggttccgccgataacagcatcgccagccattttctccgcagggagcggctcgcctgtaatcatggattcgtcaaagatggattgcggactgatgagggtagcatccagtggaaccgtgtcacccttgcggacttgcaggaggtcgccaatgcggatggctgcggtgtctaagacagtaatgtcaccattttcctcgattttgcgagctgttggaggggtcatgttcatcaaagcagcgatcgcattcttgctttttttcatggctaattcttccagagtagaagaaagggagaagatgaagatgagtagagccccctccatccagtagccaattagaccagagccgatagcagctaaaatcatgagcaggtcgacagacaggtgcttgtcgaaaatcagctcagaaatgccttccttggctgattggtagcccccgatgacaaaggctgaaatgaagaggataggagcccatccctgtccagtctgaaacagaaggatacctattagaatgagcgccaagcaaagagcggtcgtgatgatgtggctgtgttgtttgaggttggttacgagtgtcatagtttgctcttccttatttagaattattatcatttaactaagttaattataacaattataaaaagaaagtcaagttatttataataattctaaataatatcattctgataattcaaagggaaataaaaaaaagcgacagaaagccgctttgatattcgtcttttagttctggcaatcaggacaaatgccgtagatggatagcacctcttttgtaattttgtaaccagtttgggtatgagcttccttcttcaagctcgggatttctacatccatgaaatcagtgatttttccacagacttcacaaataacattgaggtgctcgtgccccataaagtcgtaataagtagtattatcattggtccgtttcaatttggtcacgaacccttcttccaatagaagtttgaggttgttgtaaacagtcgccagactcatgttggggtagttaggtattagatcttgataaatcatttcagcactagggtggtcatcgctttcgataatgtaggcaacgactgcttttctagtttcggtaatgcgtatacccttttcttttagatgttggatgacgtgttcaaaagcagtttggttttctgcattgaagtgagaatggagttccatagtttcctcctttcgttattattttataaaaattctaagatacaatattcagtttcattatagtgtatttgggaggttgtgtcaattttgagacaggaaatctgtcatagtacagtttggtgtctcatgacttgtttacatacttttcctgtgctacaatcaaaacatgacaagatataaggcaattatttcctacgacggacatgacttttctggttttcagcgccagccccatgctcgtacggttcaggaagaaatcgaaaaaacgttagtaagattgaatagtggtcagccagtaaccgttcatggtgcaggtcgtacagatgcgggggtccacgcttacggtcaggttatacactttgacttggctggcagtcgagatgtggagaagctccgctttgccctggatacccaaacctctgaggatattgatgtggtcagtgtggagcaggtggcggatgattttcattgccgctatgccaagcacagcaagacctatgagtttctggtggatattgggcgacctaagaatcccatgatgcgccactatgcgaccttctatccctatgatttggacttgagcttgatagaagaagccattcaggacctagtgggaacccatgatttcacaggctttacggcttcggggacctcggtcgaggacaaggtgcggaccattacagtagcaagtatggaatatgaccagcagcggcagttcttgattttcaccttttcgggcaacggttttttgtacaagcaggtgcggaatatggtcgggaccctcttgaaaattggcaatggtcgcatgcctgttgggcagattaaaaggattttagcagaaaaggatcgtggtttggcgggtccgactgcggcaggcaacggcctctatctaaaggagattatctatgaagactaagtatattttggcgctttctggcaacgatattttcagcggtggcgggctccacgcagatctgaccacctacacagtccatgggctgcatggctttgtggcggtgacctgcttgacagctatgacggaaaaaggttttgaggtcattccgacggagactgcggtctttgcccagcagctggctagtttgaaggatgtgcccttttctgcgattaagattggcttgcttccctctgtggaaatagcagagcaggctttggagtttatcaagactcaccaggagattcctgtggtcttggatccagtcttggtctgcaaggaaacgcacgataccgaggtcagtcagttgcgagatgaaatcttgaaattccttccttatgtcagcattatcacgccaaatctggcagaagctcagctattgctccaaaaggatatcaaaacggtggaagagatgaagcaggtggcagtggccttgtatgacttgggagccaaggcggtggtcatcaagggaggcaatcgtctgggtggctcagaggcggttgatgttttctacgacggtcaggaagtggtggtgctccagtcgcctctgctgtcagaaaacaatgtgggggcaggctgtacctttgcgtccagcattgccagtcagcttttgctgggtcaagagcctttggaggcggtcaggctgtccaaggactttgtccatgcggcgattgaaaaatcagatgattatggggtggttcaatatgagaaataaacaaacgcaagaattggtcttgctcgctatcttaacagccttgagtttggtattagcctttgttcatgtaccaactgcaactggttttgtcacactcttggatgttggggtatattttacagccttttacttgggcaagaaagagggagccattgtcggcggattgtcagggcttctgattgatttcttgttgggctatccccagtgggcattctttagtctagtattccacggggctcagggttattttgcgggttggacaggtaagaaacggattctcggtttagtcttggcgaccctctctatggttgggggctactacctggcatctcgactttattttaatgacctgaaagccattgaaagtgttctaagcaataccttgcaaaacacagttggtttggtagttggttacgtcttggctcaggcaatagaaagaattggtgcagtaaatcatgttattaagggaaattaaagaccaaactaagcaagttgtgcaagaagtcctagaactcagcgatcttcaaaaaggacagatatttgtccttggattgtcctctagtgaggtgattggagggcatatcgggaaaaattccagtctggaagttggtgaggtggttgttgaaaccatcttggaaattctggatcaaaaaggtatctatctagctgtccaaggctgtgaacacctcaatcgtgccttggtggtggagcgtgaattagcaatccagaaggacttggaaatagtcaatgtcttacccacccttcatgcaggtggttcaggacagctggcggccttcaagtatatgaaggacccggtggaagtcgagtttatcaccgctcaggctggtgtagacatcggcgacacagctatcggcatgcacatcaagcacgtccaagttccgattagacctagcctgcgtgaaattggacaggcccatgtcacagctctcgccagccgaccaaaactaatcggcggagtccgagcagcctatcaggaagatgagatacggaaaggttcataatgaaagaatttacggttaaggatttagtgtggacccgtccaccgagacaattcactatttcagatgaagaaattaccattaccacccacccccagacggatttgtggcagaagacctattaccattttgtgaatgacaatgctcctgtcttacagatggagacagaggaggactatttttcttttactgtgaagacggattttgcgggtagtcatactcgatttgaccagtgtggaattgtcctttatcaagattcggagaattggctcaaatgttcgatagagtatgaaaatgatgacttccaacacttgggaagtgtggtgactaatcacggcttttctgactgggcaactactgaagtcagttcacaaatcaaatccatgtggtttaggctcagtcgcaggggagctgattactgttttgaaaattccgaagatggtatccacttcaaacaaatgcgggtttgccattttcatcaaggggcggggaaaatagcttttgggctatatgcctgttcaccagaaaactccagttttacagctcgctttaccaatatggaattgagcgactgcaaatggcaggcccatgatggccaagagccagatgaaatatagtgagagttttaggtaagtagtaacagaaaaatagttgaaactcatactcttcgaaaatcaaaatgttccgttgtcaacttgccttgaagaactcctgttcaatcttcaccttcgtttcctaggctacttttgattttcattgagtatcaggaagtaactttcgactagtaagagagttactttttttatcttttgagccaaatccttgccaaaaaagtctggcttttgataaacttgtttctgtaaatgatacaagaacaaaaggagaagacatgacaaaaggataccaacaacgattttcactgtccattttattatggatgcgtcaggataaagcacgccaagagggaatggactactggagtggcgggcatgcacagattattgcagcttcaccgggtctattagaataccgccagcaacatttgagtgagacagaacatagtttttggccgaaagcgacaggcttggaaacggctgttccagaagatcgtcggattgatggcattgcggaagtgacctatcaaaagttattggcaccaataggcggtcgccgtcagacggccctggcctttgaagatgaggtcaatgttttccgtcggactttgatgcacatgggcttcccttattcatcacgttggtaccatactagcactcaggcccaaacccaactgcgtgatgtcctatacttccgtcgcaaagatggggtgaagagcggtagcttcaaaaaatttgttcaagatggactcgccagtcaactggcgacaatctctggggtaacggaagtacgaacacaggtctatcttccttggaataaagcgacttggaataccccaaatgttgcccatgacaatcctaaagaagaccatcttcatgcctccatcatcccaggttttgcggatcaggcggcaagagaggccttctatgccaaccaggctccgcagttgaatgcagaagtggtgcaatactcctcagcagtccacgcttatcatatagaaaaaaccttgccatttgtcctagacggcaaacgcatgtaagacaagcgacttcttggtcgaatgctttgttaaaaaaatatagtcgaatgaattagctttcagacaaggaaccgaggtgcaggttgctagcacagcctagtggctgtgctaggttggagatataacttgcaaagcaagtcacttctgcagagtacggcaagccgaaagtgacgatgtatcaaagttaattcaaatgactataaagcaaaagacttgccaagaagtctagcttatggtaaacttgttcttgtaaatgatacaagaacagaaaggaaaccagatggatacaaagttttcagtagcccttcatatactgaccatgatcagtgagagtaaggaaatacttagctcgcaagccttagctgagagcgttggcaccaatgccagctacatccgcaaggtgattgcacttttgaaaaatgcaggcttaatcacttcgcaccaaggccgttcaggctaccaattgagcaagtctcctaaggatattagcttattggaaatctaccttgcgacgcaagaagtggagcatattcgcctatttcagatacaccagaatgccaatctttcttgtccggttgggcagcatatagaaggcgcaatggttcccatcttttccagcgttgaacaagaactggaaaatcaactcagtcgtcaatccttagataatgtgattactaatctctatcaatccgcacaagtaacccgaatctgacctcggtcagattttataaactcaaacatagacctgtaagtgatacaggaacaaatgatataatagaaaagagaagaacatgaaagcagcacaacacacatcttataacaaaaacaacatcgcccttaaccttacagaaattgctaagccacaaatcaagcctaaccaagtccttgtcaaagtgaccgcagcaggcgttaaccccttggacaacatgatttcacgcggagatgtgaaattgattgtcccttacaaattgccccaaacagctggaaatgaagtggttggcttggttgaagaagtaggttcaagcgtgacgacctttgcagcaggggatcgtgtcttcggtcgtcttccgcttgatagtatcggtgcttttgctgagtatgtagcggttgacgctcaggctcttgctaaggttcctgcctacttgacagatgaagaagcagctgccgttcctctgacagctctgaccatcatgcaggcacttgaccttatgggggcacaatctggcaagaccatcttcatctcaggcggaactggtggtgtcggaggtatggccattccgattgccaaagccaagggcttgaccgttatcacaaatggtgatggggcaagtgcagagcgggtgttgtcattgggtgcagaccgttttatcgactacaagacagaagattacaccaaaacacttagcgatgttgactacgtcttggacacacttggtggtgcagaaacagagaaacaaatgtcaatcatgaaaaaaggtggacagctggtttcccttcgcgccatgccaaatggcgaatttgccaaacgtatgaatttgccaaaatggaaacaaatcttgtttggcctagctggtcgttcatttgacaaaatggcaaaaaaatacggtgttcactaccatttcattttcgtagagagcaatggtcgccaactgcaagaagtagcagacattttcaacaagctcgaaatcaaaccgtcaatcgatacagtttatccatttgaagaagtcaacgcagcacttgataaggttgccaacggtcgttcacgcggaaaaacagtcctcagtttcaactaaaaaataaaatatacagggaaaaatcatgtcatatattacaaccaaaaaccaatacatcaccgtttcaaacaataaaatcgcctatcgtgagctcagcaagggcaagtctgacattcctttggtcatgctggtccacctagcggccaccttggacaactgggatcccaaattgctggatttgctggctgaaaagcaccatgtaattatcctagaccttcctggcgtaggagctagtcaaggcaaggtggctccgactattccaggaatggctgagcaggctgttgctattatcaaggctttgggtcatgagaaaatcaatttgctgggtctgtctatgggtggttttattgctcaagaaatcgttcgtctggatagtcagctggtcaaccgattgattttagcaggtacaggtcctcgtggtggttttgaagttgataaggtaactggaaaaaccttccgctatatgctgaaggctggtttagagcgtgtggatccaaaacgctacattttctacaatcatgatgaagcaggtcgtttggaggcagaaaaagtcttgggtcgtatggggcaaagaagtgctgcacatgcagacaaggacatgaatgttccaggatttttgacccagctgaaagctatcaaacgctggggaagagagccgcaagatgacatgacctttattacccaaccaactctgatcgtcaacggtgataaggatatgcaagttccgacagaaaattcttataccatgcatgaaaaaatcaaaaatagccaactgattatttatccaaatgcaggacacggctcgatcttccaaaatgcagaagagttttcaaaagccttactagcctttttggaggaaagcaatgcctaaaactattttaatcacaggatcgacagacgggattggcaaacacctagccatgaaactagctagtgaaggccatgaagtgattttgcacgggagaaatagcgaaaagctccgtgtagctctcagtgacattcagctaaaaacaggaagtaaaaaaattcatggctaccttgcagacttttccaagttagcagatgtctatcgtttcagccaagaaattaaacgcgattttgagcagattgatgtcttgttaaacaatgcgggtgcttactttggtgatgcgcgtgtagcaacggcagaaaatatcgagatgacctttatgctgtctgtccaagttccgtatatcttgacgacggagttacttcccttgctggaaaaagcagcaggcagggtcattcatacctcttccttgatgcaccattttgcacaaaccagaggcttggattttggtttagagcagagctattctgcagccatggcttacaataatgccaagctttacaccatttggctggcaatagctcaggcagaggccttagaaaagcaaggttcatctgtgaccgtcaatgcctaccatcctggcttgattgcgacaaatttgggcaatgatggtatcaaacgcaatctgagaagtcggattctcaccagtctgatgaaaccattttccaaggatttggaccaggggattgaaacgggttactacttaagcttgtcaccagaggtggctggagtatcaggtcgttattttgcggagaaaaggttggctaatgtcagcttgaaaggatttgatttggcaaagagccaagccttactagcctatcttgataagaaaattcaagtatttaaggagagctacggtgactaagattttgttagaaaacctccaactgcccaatggtcaggtcttagacaatcgctttttcaaatccgctatgagcgaaaccctggcagatagtcagggagctccctcagatgacctgattgccttatatgatttttgggccaagcagggagtgggtgtcttagtgacaggcaatgtcatggtggacggccgctaccttggtgagccgggcaatgtggtccttgattcagacgctcatctggctcaatttcggaaatgggcagccgttgggaaaaagaacggtgtgcctatctggctccagctcaatcatcctggcaaacagatgtatcggtcgatcaatcaaactccgattgcacccagtgccattccgatttctggaggttcagcttcggcctttcgtccaccgagagaaatgactgtgtttgacatcaaagaagccagagataaatttattgcagcaggccttagggcaaaagcagcaggatttacaggtgtacagttacacgctgcacatggttacttgaccaatcaattcctctcaccagcggataatcagcggacggaccgctatggtggcagtctggacaatcgcatgcaattcttggtggaagtttatcaaggtctgcgtgaaaaagtgggaccagattttaccattgccttgaaattgaatgcttctgattttaaggaagagggttttggttttgaggattgtaagcatgtggtgaaaatcatgtctgacttgggtattgacctgattgaaatttcaggtggcaattatgagacacctgtttttggtagtgactatgagaatggtgctggatttgtcacctatgcccttgctctagcagatttgacttctgtttctattgtttcaacaggcggtttccgaaaagtcactcagatggaggaggctatcaaggatggtgtgtccatgattggtcttgctagaccctttgtccttcgtccaagtcttgtcaatgattaccgtcaagtcggtgatttgcaagcagacggcgaacggacaggtcgttatattcttggcggtgaagagttggtcttgaacagcaagggagaaagcgttatttcctatgcagattatgccattggtatgattgacgagattgcaacaggtgatcatctcaaagcacgtatcagccttgtcagtgagtaaaagattgttatgcagatttcaaataaatttaccattgccattcatgccttggcttttatccatctctttcaagaccagcaacgtgtcaccagcaaggttttggcaaacagtattcaagccaatcccgttatcattcgctcggttctatctggtttgaaggaagcgggaattgtagatgccaagcagggtagcggcggttttcgtttagcaaagacgcttgatgacattagtctttatgacatctttgttacggttgacaatattgataagaaaggcttgttcaactttcatgaaaatccccatcccgactgtatcgtggggggaaatatccatgctgctgtggacgacaaactcgtccaagtccagacagctatggagaaagaattgaaaactatgtatatgtccgatgttctggttgacctagaaaaagccattgaagaaaaagtgaaaaggacttaaatgggagtgggaaagaactcgaccattcatagaagagttcgtcttcccacccccgcacagttgattaggtcagatttggagtgtaaaacacgaacaaatctgccaatcaaccactgcgctgagatgttgacacgaactctaagtagtggtcctgggctttttgcccatcctcactatacacaaaaagacttagagtgactgaacatcagttgtctaagtctttttgcttggtttggtcaagaacgttgacaagcttgctctattgctcactcatcaaccgcatgatgtcatcagggctttccttacagcctcgagcaacccaggttttgagcactcggaaaaatcctcctacgataaattgcaggtgaaaatcatcagtcaagtcccccagtttttctttgaaatagcgatccaagacctcctcgagcaagtagtccaaatggttggcagtcaataagcgaatcttatcctgttgctcataccaaaagtcaaaaaattgccgtaaagctagtaagagatgagcatctgaccaatccgacaagtcaatctgccgttcggtcaaccaggcttgcgattccaagttgaaggatcgttcgagcacctcttccttattggaaaagtttcggtaaaaggtcacccgaccgatgccagctcgctccaccaactctgacacactaatcttttcaaaagatttgtcttccagtaactcccacagagcctccacgacactctccacaaataatgactctttccgcttcactctttccatgcgaaacacttcctttcctttgtttccttttggggaaatagcagagctgggactagttttcccactgtccatctgctatactgataaaaacgaaacacttgtttctaaaaatataccataaaggacagaaaaaagaaagtatgaaaaaagttttaatcggcattgggattttaatagcttgttttggtattggtttcctgtatttagccagcaagccatcagtggcttctaactacacagaagtagttgaaacgggtggagctgttgagaaaaagtatcttggacagggcaactatgacgtttcctatctcgaaatcaatgctttacaaaatttcaaaaaatatgaactgtactatcctacaaatattgaaacagaaaccagaaaatttccagtagtgatattttctaatggtaccggtgttagagcttctaagtatgcgtctgttttgaaacatttggcttcttggggctttattgtcattggtactgaggaagaatattcttggaatggattttcatccgaaatgagcttgcgacttgctatcaagctaaatgataataagactgttgaaggcctaaaatcaaatcctttctttagtaaagtcgatttagataagatcggcctatcggggcattctcaaggaggagttggggtctttaatgctgttacggaacaaaagcatgggcatatgatcaaaactatttacgcggcaagtcctgccaatttagaactttctagtaatttagaatgggactatgacccgagcttgatttctgttccgacctttctagtatcgggtacgggaggtggatatgaggatttggtagtgtctggcaagcagttgacacagatttatgagacattaccagctaccatcacgaaggtaatggctcggagaaaagaagcaggacatggtgatatgcttagacttccaaacggctatatggtagcttggtttatgtggcggttacaaggagcccctgaagcagagacggcatttcaaggaaactccccagaaattgttcaaaacaaactctatcaagatcaaagaataatgaactaggatttgtatcattgacggtcaaaagcgagttctgtctttctattgtttgttcttgttttatgttagtagcttattcaaaaaatgtgtaaaaagagtgtaattcttcatgaaaaaattcaaaaaaatcatcttatggacccttgggattgtagccagtctcggtatcattgcttatgtgtctgttaccaatcatccgcagttggtagtcggtgtcattcaatcgtttatgtacaaagagagttcaccgaactcttacagtcctctttatgatcccattgatggtctgaaagaaaatggtcagtatttgaaaagtgagattgcctatagtaaggactatcccaacagttttttagatattacctatccagaccaaaatcttgaagctgaccgaccaaccctcttctatttccacggtggtggattctttggaggtagcaaaaatatgggggcccctctgtcagctagccaagcgacctacctcattgatgacatcgtgtcaaaaggatataatgttgtcaatgtggattatgctcttgtaccagaccaccatttcccaacgccagtgattcaaatgaatcaggctatcgcctacatgaaggaacacgctgaagaatatcacttgaacatggacaatgtcgtcttgatgggttcatcagcaggtgccatcatggcggcacaatatggtagcgtcttagccaatcaagagtacgctcagctattgaatattgaaccaagtattgcaaaagaagatgtcaaggctctggttatagacgatgctcctttagattatgccaaatttagcctaggtacgaagatcttggttggaaattatgtttcagaaaccatctatctaagtgaggaagaaatcaatgcctataaccctatttcccatgtgaataaagactacccagctagtttccttctgggaagcgaggatcgaacagatatggtgtcgctcaacaaggctttgaagcaagcgggagttgaaaatgaattggtcgatcctttggcagaagaagggcttgaaaagcctcatggttttgtggcgaatttacgaacagaccctgtgtctgccaaagcatttgaacggttgatgatttttatagacgatagaaccaaggaatagtcggagtgttgataagttggaaactgatagggatttgtccaatcaatctgtcgctctgacaaccatgtttgtactcagaaagtctacgccgaaaaattccaagtgagaacaataagtcccagctctgccatttcccaaaagtacgttataaaatcgttgaaatccttgtcaattgtgttataatgaagagtatgcaataaaattttaaggagaatgacagaatgtctgtatcatttgaagcaaaagaaacaaatcgcggcgttttgactttcacaatcggtcaagatgctatcaaaccagaattggatcgcgttttcaacaaagttaagaaagatatcaatcttccaggtttccgtaaaggtcacttgccacgtgccgttttcaaccaaaaatttggtgaagaagcactttatcaagatgttgtaaatgcattgttaccagcagcttatgaagcagcggttgcagaagctggtcttgaagtcgttgcacaaccaaaaatcgacgttgtatctatggaaaaaggtcaagactggacaatcactgcggaagttgtgacaaaacctgaagtaaaattgggtgactacaaaaacttggcagtttcagtagaagctactaaagaagtaacagacgaagaagttgacgcaaaaatcgaagctgcacgcaacaacttggctgaattggttatcaaagaaggtccagcagctgaaggcgatacagttgttatcgactttgtaggttcaatcgacggtgttgaatttgacggcggtaaaggtgagaacttctcacttggacttggttcaggtcaattcatcccaggttttgaagcgcaattggttggtcacgcagctggtgaagaagtaaacgttgaagtgactttcccagaagactaccaagcagctgaccttgctggtaaacaagccctcttcgtaacaaaaatccatgaagtaaaagcaaaagaagttccagctttggatgacgaattggcaaaagacatcgacgaagaagtggaaacacttgatgagttgaaagctaaataccgcaaagaattggaagcatcaaaagaagttgcctttgacgatgcagttgaatcagcagctcttgaattggctgtagaaaacgctgaaatcgttgaattgccagaagaaatgattcatgaagaagttcaccgtgcaatcaatgaattcttgggtggtatgcaacaacaaggtatctcaccagatatgtacttccaaatcactggtacaactcgtgaagaccttcataaacaatacgaagcagatgctgaaaaacgtactaagacaaacttggttgttgaagcagtagctaaagcagaaggtttcgaagcaactgaagaagaaatcaacaaagaaatcgaagacttggcagcaacttacaatatggaagtggcacaagttcgtagcttgctttcaccagaaatgcttaaacacgacatcgctgtgaagaaagctgtagaagtgattacaagcactgcaactgtaaaataattatttggaaaactcgactctggtcgggttttttgtttaatcatctttcgatgttacaaagaaactctctgaaaaaccttgtccgtcccatgcagaaatgggagaatgtcatatctgttggtggagtcgtccaagtttcacaaggggtacgaataactgacggagaggtcagccattaccagttgccgtggtcggtgctcccatgtttacaagctatcgaatatgactgttcttttttagggagtagaattttattggactatttgcaatccaatctcatcatatcaggtgcctttgggttattttacaaggagtatgtcatagcagttgggggttatgataggcagacactgggagaagatatggagctagtcatgaaattgcattatttctgtagaaataacaatattccttatcgaatctgctatgaaaccagcgccatttgttggagtcaagcaccgagctctatcggtgatttatgcaaacaacgccgtcgctggttcttgggactctatcaatgtctaaaaaaataccgaaaaatgttatcgcgagttcgttttggggcggtgggatatttttcctatgcttactatatgctatttgaatttttggctccgtttatagagactttcggttgtttcgtgattctactttcgttgatctatcatcaactaaacatctcatttttcatatcgctctttttcctccatagtgctttttgctcactaatcacctttgcgtcatttttgcaacgcgtctactcgcaagatttatttattggacctatggatttgtgtaaagccttcctggcaaccttgtttagatattttttcttgcattgggtattgaatattgtccgtctgacaagttttattggatataaaaagagaaagcgtgaatggggagaaatcaaacgagtgaaacaattcgtttaagtaaaggtaagactggcttataaaaagaaagtcttatctttttttaaaaaatacttgactggttaatattcttgtgttatagttaactggttaacaaaggaggaagttatgttaaagaaagtgataagaggctgttttgttgccttattcggttttgttttagcagcttgctcggctcagaaggaagcgagtcaagtacagccaggaatgaaaatagtcacctcattttacccgatttattcactggttaaggaagtgtcagggaataaaaatgatgttcgaatgattggctcaagacagggcatacactcttatgaaccatcggctgcggacataaaggccatatacgatgcagatgtttttatctatcattcgcgaattttggaatcctgggcaggacgtttggaacctaatttgcaaggttcatctgtcaaggttttggaggcttcgacaaatttaccgctgacaaaggttccagggttagaagacatggaagctggtcaagggattgatgaagctagtttatatgacccccacacatggctggatccagttttggttggtcaggaagctgttgcgattggtgaacttttagcagaaagtgatcctaagaatgcggattattatcgtcaaaatgccgcaactttagagggaaaggcgcaaaagttggcagacaagtatagcccaatctttttaaaagccacatcaaaaacatttgtcactcaacacacagccttctcttacactgcgcaacgcttcgggttgaagcagttggggatcgcaggagtttcagaggaagaaccaagtcctagacagttggcggaaattaaagaatttgttgacacctacaatgtgcaaacaatttttacagaaaaaggtgcctcggataagcttgccaaggcattggcgagttcgacaggtgtagatttaaaagtgttggatcctcttgaagcagatccagaaaataatttaacctatctagaaaatctagagcaagtcttagaaacattagctcaagagttaaaataaaaggccgaattctatcgaccgaaaggagaaaaaatgaagaaaaaagcagttgttggctccgtagccgcccttgttttagggatgagtctctgtagctatcagcttggacgtttccaagcgatggaagagcaaaaaaatcgtgtgtcctatattgaagatagtcaaagtgtgcaaactaccgttgctgaacaattaacacctgatcaagtttctgccaaggaaaatattgacgctgagcagatagtcgttaaaattactgatcaaggctatgtgacatcacacggtgaccatttccactactataatggtaaagtcccctttgatgcgatttttagtgaagagttggtcatgaaggacccaaactatgtcttacaagacagtcacatcattaatgaagtccaggatggctacgtcataaaagttgatgggaaatactatctctatctaaaagaccctagcaaacataaaaatgttcgtagcaaagaagaagtggagcggcaaaaaggaatctcttctgctgacagcaaaaatcaggcagcaggaaatagtaaggatggccgctacagaacagacgatggctatgtctttaatccgacagatgttattgaagacacgggagatggttttatcgttccgcacggcgaccatttccactttattcctaaaaaagatttatcagctgccgaattgaaggctgctcaagattactggaatcaaaaaggaagtgtgagctcggctagtggtagtcaatatggcgatagaaataatagagctcaacagaccacaattagtgcggggcaaggtcaggatttggctagtttattggctcaattggatgcaacacccctatctcaacgccatgtagaagcggatggattggtatttgacccaagaacgattacgaagaaaaccgcagcaggtgtcatcgttccacacggcgatcattaccactttattccatacagccagatgtctcctctagaagagaagatttctcgaatgattggtgtaaatggagcaggtgtttcttctggcgcacaagcaagtcactcccaacatacactaacacaaccaaatcgtccagtaacaccaatcggcactgttacaacgcaaccggtatcgcctacacaaccagtattaccaacacaaccgaagcagtcaacagggaaagtggtttcctataagggacgtcaaattcctgcttacggaaaagggttagatggtaaggcatattttacaagtgatggatacacctttagcaaagactctattacctcagttgatgatcaagggttgatagctagtcatggagatcatttccattatgttggttttggcgaactcgaagattttgaaataaagcaagtagaggaatgggttaatgagaaggcgggcaaacaagtgccaccgaaaacatctgaacaagtaggaaacgatgctaaacccacaacaccaagtcaagggaatgattcaaaacctgtaaaaccaattcaagaagaaaaccgccctgcatttgaatataaacaagtaacggctaaacgtaaattggctggaaaagttgtttatgaaatggaagtaggtggaaaaacttatacgtatggtcgtgacgaactagatttgatgaagatctcttttgctgagttgactttggcagaaaaagataagcagtatatctttgatattgcaccgcttgcagaaggagatcttaagccagccatgttggtcggtatggatcaaattccgatgaagggagcgaatgcgacctatgatactggacaatcctttattattccacacattgatcacatccacgtcctaccttacacatggttgagtaaggaacaaattgcaacgatccgctatatcatgcaacatcctgaaattcgtccatctgcttggactacaagtggacatggtgatggagaagcaacggatcttgttcccccaattctaaatgcaacacctaaagcaaaccgcttaggcttgaaaaattggcaaatcattcacacagcagaagaagttatggatgcgcgtgcaaaagggaaatttgcgacaaatgatggctatatcttctcggcggaagacgtactagatccagcaagttttgtctttagtcaagcgttcagtctaccaagagcgacaggaggttctctacgttcaatttccaagaaagatttatctaaagaagaattggaagctgtacaaactcttcttgataaacgagacgctgaagaattggcgaaaaatgtcacaccaattgagaaacgtgcaggtttgaaaaattggcaaattgttcactcagcagaagaattggcagaagctaaggcagcaggaaaatatacaacaaaagatggctatatttttgacccagcggacctattagatcccaaagtgaaaataggtacggataactatcgcatcccacgtgtgattacagatggttaccgtcggattaacaagagtgatttgaattacttaagcgagctgatcccagcagaggctatggtggctcaacgtgagaaatctaattctagtttaccgtcaacacctgcaccaactgaaacaggagcaagtgcaggcgagacaacaacgccagaacagccacaagttgccaaagaaacagcagaggaaatttataaccgagtggaagcgaagaaagtcgttcctttcgaagcactgacttacaatgctggctatgcaaccgaagtacgcaacgggactctggtgattccgcatcaagatcactatcactatgtatcctttaaatggtttgaccaaggtagtgcaagaagtcctgaagggtatagtttagaagatttcctagcaacggttaaatactacatgactaatccacaagaacgcccagtttcagacgatggctggggagtatttacaccaaatacaccatctgaatcaacagaagaaacagagacggaagaaagtgatgaagaaattatttctgaagaaaccgaggaaattgacgagtttacagaagaattaaaacgaagagcagaagagtttggcatggacttcaaaacctttgaacaaagtctggtcacactctcagaccgttacaaagtttcttttgaagctttcgaatatgatgcagcaagcaaagttgttcgacttgtagataaggatggggtcaaacggaccatctcccttccaagtttagaagaacaagtatagtaaacaaaatacctgtagcactgagctctgcaggtatttttttacagaaaaacgataaagattatctttgactatttgccttttttagcgtaaaatagaagggaaagacaaaaaaggagaacagccttggaacttaacgtatttgcaggacaagaaaaaagcgaactttccatgattgaagtagcccgtgctattttggaagaacgtggacgtgacaacgaaatgtatttcaacgatttggtcaatgaaattcaaaactaccttgaaaaatcaaacagcgagattcgcgcagccctcccaaccttctattctgatttgaatgtggatggaagcttcattccgcttggcgaaaacaaatggggcttacgttcatggtacgcaatcgatgagatcgacgaagaagtgatcactcttgaagaagatgatgaagatgcaccaaaacgcaagaagaaacgcgtcaatgcctttatggacggtgatgatgatgcgattgactatggacatgatgatccggaagatgaggataactatccaggtagtgtatcatcagaatacgatgatgaaaatccagatgacgaaaaagatgaagttgagtcctatgattcagaaatcaacgaaattatcccagatgacgaattggatgaagaggatgttgatttaggtgaagatgacgacgagtattcagatgaagaggtcgtcgacgaataagaattatatccccatagattcttaaaaataatttgacaagactactgaattacgataagatattatcgggcacctcttttgaggtcggagctccctagcgatagggagctatttttgttttttcttcaagttaacaggaagtatccccacaaattgcttcctattagcctgaatcgtagaaaaggagtttgcatgacaaagtatatttttgtaacaggtggcgttgtttcctctatcggcaaagggattgtagcagccagcctaggtcgtttattgaagaatcgaggtctcaaggtaacaatccaaaaatttgatccatacatcaacattgacccgggaacaatgagtccgtatcaacacggtgaagtttttgtgacggatgacggtgcagaaaccgacttggaccttgggcattatgagcgtttcatcgacattaacctgaacaaatattcaaatgttacaacaggtaaaatttatagcgaagtcctccgtaaagagcgtaaaggggaatacttaggggcaacagttcaagttattccacacattacagatgctttgaaagacaaaatcaagcgtgcagctcgtactacagatgcagacgtcatcatcacagaagtgggtggtacagtaggtgatattgaaagcttgccattccttgaagcgcttcgtcagatgaaggcagatgtcggttcagacaatgttatgtatatccatacaacactcttgccttatctcaaagcagcaggcgaaatgaaaactaagccaacacaacattctgtaaaagagttgcgtggtctaggtattcagcccaacatgttggtaattcggacagagcagcctgctggacaaggaattaaaaataaactggcacaattctgtgatgttgctccagaagcagttattgagtccttggatgtcgaacatctttaccaaatcccattaaatatgcaagcacagaacatggatcaaattgtttgcgatcacttgaagctcgacgtacctccagcagatatgacagagtggacagcgatggtaaacaaggttcttaatctccagaaaaaagtaaaaatcgctttagttggtaagtatgtagaattacaagatgcctatatttctgtagttgaagctctaaaacactcaggatatgcaaatgatgctgctatcgaattggactgggtcaatgcaaatgatttgacagcagaaaacgtagctgaacgtctaggacaagcacaaggaattatcgttcctggtggctttggacaacgtggtacagaagggaaaatacaagccattcgttatgctcgtgagaatgacgtgccaatgctaggggtctgcttgggaatgcagctgacctgtgtagaatttgcacgtcacgttctcggtttagaaggtgctaacagctttgaattagacccagaaacaaaatatccaattattgacatcatgcgtgatcaaattggagtggaagatttaggaggaactctccgtttaggtctttatccaagcaagctcaaacgtggctccaaggctgcagctgcttatgataatcaagaagttgtacaacgtcgccatcgtcatcgttatgagtttaataatgacttccgtgaacaatttgaaaaagcaggttttgttttctcaggcgtgtcaccagacaaccgtttggtagaaattgttgaaattccagaaaataaattcttcgttgcctgccaataccatccagaactacaatctcgtcctaatcgccctgaaggtttgtatacagcctttgtttcagcagctatggagaatgaaaaataagtataaccattatagaagaagattggtatcattcaatcttctttatatattttatataaagaaacgaaaaaggtgtcagtattttatagaagaaaatacgaaataccacccccatatggcatcattgtctagatggttttaagcattatatatagtagaatattgcaaaagaatcagctaaatcaatacgttttggcaaaaaaaggtaaaaataaaaaataaaattcaaaaaaagtgttgacaaggctagttcctaatgatatactagttcttgtgttaagcggggatggcggaattggcagacgcgcaggactaaggatcctgtgaccgctttaggtcgtgtgggttcaagtcccactctccgcatagtggactagctaaggctagtccttttgctttgtctagataagtgcagagcacgatatatgctagttcataaattacaagaatgatacgaaacaggcattattatggctttcatgaaaagatatgtgaaagttttctcaaaactagacggtttcaactagcattttcaaaataaaaatggtagaatagaagagtatgaggtgcaacctcaaaaaatattaggaggctatcgaaatgccattagtttcagcagaaaaatttgtccaagcagctcgtgacaacggttatgcagttggtggatttaacacaaacaaccttgagtggactcaagctatcttgcgtgcagcagaagcaaaacaagctccagttcttatccaaacttctatgggtgcagctaagtacatgggtggttacaaagtagctcgtaacttgattgcaaacttgattgaatcaatgaacattacagttccagttgctattcaccttgaccacggtcactacgaagatgcacttgagtgtatcgaagttggttacacttctatcatgtttgacggttcacaccttccagtagaagaaaaccttgcaaaagcaaaagaagttgtagaattggcgcacgctaaaggtatctcagttgaagctgaagttggtactatcggtggtgaagaagatggtatcgtaggtagcggtgaattggctccaatcgaagatgcagtagcaatggttgcaactggtatcgatttcttggcagcaggtatcggtaacatccacggtccatacccagcaaactgggaaggtcttgaccttgaccacttgcgtaaattgactgaagctgtaccaggtttcccaatcgtattgcacggtggttcaggtattccggatgcacaaatccaagaagcaatcaaattgggtgttgctaaagttaacgtaaacactgagtgccaaatcgcatttgcaaacgcaactcgtaagtttgcagcagcttatgaagcaaacgaagcagaatacgataagaaaaaactctttgacccacgtaaattcttggcagacggcgtgaaagctatccaagcatctgttgaagagcgtatcgacgtattcggttcagcgaacaaagcttaatgtaactgcgaagaaatcttagatttcaagcaaacaaagcataagtttcttagattaaaccaaaaaggattttctttcgagaatcctttttattataatagttgattaagtttgatctagttctttgctatgaagaaatctacgatagaagtgagcagagaacagttaaaatataaactgctccaaagttttcatgactgtaataacttagagaacgaagaattatggatggggcgcaaactgtagtattaaaatatttacctatgagtatagacactttaaaaaataaaaatgaaaataattcttgccaagtccaatcttttctgttagaataatatggtatgtggtgctagcacatccgatatatttgatcaaatgaggaggaagatacaatggctaaagtatgttatttcactggtcgtaagactgtatcaggtaacaaccgttcacacgctatgaaccaaactaaacgtgcagttaaaccaaaccttcaaaaggtaactgttttgattgatggtaaacctaaaaaagtttgggcttcagcgcgtgcactaaaatcaggcaaagttgaacgtgtataataacaaagtcgttagaaaaatctagcgacttttgtttttggaaaaaatagcctagatataaagtcggtgaggagcaaattcgaccactacataatgaataggaaagaatatcagctatatagctcttcacattgctgttgaaaagttaacaaagaaggaatgttgtcaaaaataaactgtgtattgatgtggaagatttttccaagttcgaacatttaaacttggattgacattaggagttgtacgagagagcatccgtacgggttctacaagaagggaatcacgaactggaagaatagagagtgtttaaaaaaatccaaaaaatctcaaaaaaccggttgacaatgtatataagtcatgatagaataaatgagttgtctcttgagggactagttaacagagaaacgaaaaaagtttcaaaaaagtgttgacaaagttcacaagaaatgataaactaagatagttgtcgcgagagcgcgataacgacaagacctttgaaaattaaagaagacgaaccaaacgtgcagggtgatttatctaaagataaatcgtcaatgacaaaacaaaacaataaaacggaaagctagcaatagcttgagtttgaatcaaaactttttatgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaaatggaaacctgtacgtcagtcttctttaattttgagaggtcttgtggggccttagctcagctgggagagcgcctgctttgcacgcaggaggtcagcggttcgatcccgctaggctccattaacaacggaagttgttaagattttgtccattgaaaattgaatatctatcaaacattcctaaacgtatgtaaaagtacgtatagaaatagtaacaagaaaataaaccgaaaacgctgtgaatatttaatgagttttctaatttttgaaaaaattaggttaaaacaagttacgaagacgttaaggaaaacgtatgattttaggaaatcatcgcagtagtctaaggactacaagaggatttgtctaaatcactagttttctagtctgagtacgattataaggttaagttaataagggcgcacggtggatgccttggcactagaagccgatgaaggacgtgactaacgacgaaatgccttggggagctgtaagtaagcaatgatccagggatgtccgaatgggggaacccggcaggtaatgcctgtcactcactactgttaaggtagtgaagaggaagacgcagtgaactgaaacatctaagtagctgcaggaagagaaagcaaaagcgattgccttagtagcggcgagcgaaacggcaggagggcaaaccgaggagtttactcctcggggttgtaggactgcaatgtggacttaaagagtatagaagaactacctgggaaggtaggccaaagagagtaatagcctcgtatttaaaatattttttatacctagcagtatcctgagtacggcgagacacgcgaaatctcgtcggaatccgggaggaccatctcccaaccctaaatactctctagtgaccgatagtgaaccagtaccgtgagggaaaggtgaaaagtaccccggaaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcggattagtattatgtcgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacatttgagaatcttggaggtagagcactgtttggatgagggggccatctcggtttactgatttcagataaactccgaatgccaatgatttatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggataacactttagtgttatggtaggagagcgttctatgtgtgaagaaggtataccgtgaggagtgctggaacgcatagaagtgagaatgccggtatgagtagcgaaagatgggtgagaatcccatccaccgtaagactaaggtttccaggggaaggctcgtccgccctgggttagtcgggacctaaggagagaccgaagggtgtatccgatggacaacaggttgatattcctgtactagagtatgaagtgatggagggacgcagtaggctaactaaagcgggcgattggaagtgcccgtctaagcagtgaggtgtgatatgagtcaaatgcttgtatctgtaacattgagctgtgatggggagcgaagttaagtagcgaagttagtgacgtcacactgccgagaaaagcttctagcgatgtatcatactctacccgtaccgcaaaccgacacaggtagtcgaggcgagtagcctcaggtgagcgagagaactctcgttaaggaactcggcaaaatgaccccgtaacttcgggagaaggggtgctggcttaaagtcagccgcagtgaataggcccaagcaactgtttatcaaaaacacagctctctgctaaatcgtaagatgatgtatagggggtgacgcctgcccggtgctggaaggttaagaggagggtttagcgcaagcgaagatctgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctacgaagtcgggacgccagtttcgactgaggcgctgttgggatactacccttgtgttatggctactctaacccggataggttatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggacgggataaacgctgaaagcatctaagtgtgaaacccacctcaagatgagatttcccataactttatgttagtaagagccctgagagatgatcaggtagataggttggaagtggaagtgtggcgacacatgtagcggaccaatactaatcgctcgaggacttatccaaagaaataaactagagtcaatattgacaagcgatcggtttcttgttagaatatagatattcaattttgagttgacaagactcagtagttaagtgacgatagcctaggagatacacctgtacccatgccgaacacagcagttaagccctagaacgcctgaagtagttgggggttgccccctgttagatacggtagtcgcttagcatattccgccatagctcagttggtagagcgcatgactgttaatcatgatgtcacaggttcgagccctgttggcggagtaaagagaaatctttagtatatggtccgttggtcaaggggttaagacaccgccttttcacggcggtaacacgggttcgaatcccgtacggactatatttggagactgcttaagtctcttttttttgttttttgaggtgtatgggctttaatatggctcctttttcttttcttgttactttgtctattcattgtttgttgatataatagagatatgaaaagactatgtgatgaattatcggttttgccagggattggtccaaaatcggctgaaaaattcttaaaaattagcattcagaatattaatgatttgctgacttactatccatttagatatgaagattttgagagtaagtctatttatgatttgcaggatggggagaaggcagtggtagttggggaggtggtatctccagctaatgtacagtattatggttacaaaagaaatagactccgtttttcaatgaaacagggtgaggttgtcttagcagtttcgttttttaatcagccttatttagcagataagattgttttggggcaggatattgcagtttggggaaagtgggataaggctaaggcaagtttgacaggaatgaaaattttggctcaagtatcagatgagctccaacctgtctatcatgtggcgcaagggatttcgcaagtaaatttggttaaggctattaaaacagctattgatcagggatatttgcatttattagaggagaacttgccatcagttttacgagagcgctatcggttaatgaatcgccgagaggcggtttttgcgatgcattttcctacaaatttagaagagtatagacaagctttgcgacgtatgaagtttgaggaattattttattttcaattacagttgcaaatgctgaaagccaacaatcgtgatattttgaatggtttgaagattgcctatgatgctgatagattggctatgcaaataagacaattgccgtttgtcttaacagatgctcagtctggggctttggctgaaatactatcagatatgaagtcctatgggcacatgaatcgtttgttacaaggggatgttggttcagggaagacagtagttgctggattggctatgtttgctgctgtgactgcggggatgcaggctgcaattatggtgccgacagaaattttggctgagcaacactttgagagtttgcgccagctttttccagaactttctattgctcttttgacaggtggaatgaaagctgcggagcgtcgtactgctttagaggcgatttctagtggtcaggtagacatcattgtaggaactcatgctcttatacaggaaagtgtgacgtaccataagcttggtttggttgtgacggatgagcaacatcgttttggtgttaaacagcgccgtctgtttcgtgagaagggtgataatccggatgtgcttatgatgactgctacacctattcctcggacgttagccattacagcttttggagatatggatgtatcaattattaatcagttacctgctggtcgaaagccaattatcactcgctgggtcaaacatcaacagctgcccacggtcttagattggttggagcgggagttagaagtgggtgctcaggtttattttatctctccgctgattgaagaatctgaggctctagatttaaagaatgctgtagatctacaatctgatttacaggcgcattttggagagcaagttacagtggatttgttacacggtaagatgaagaatgacgagaaagatgccatcatgcaggcttttaaggagcgaaaaacgaatattttggtttctaccactgttattgaagtcggagtcaatgtgcccaatgcaacggtgatggttattatggatgctgatcgttttggtttaagccaattacatcagttgagagggcgtgtaggacgtggtcataagcagtcttatgcagtgttagttgctaatcctaaaacagagtctggtaaggaacgcatgaaaattatgacagagacgacagatggttttattttggctgaagctgacttaaaaatgcgtgggtctggagaaatatttggaactcgtcaatcaggtttgccagaatttcaagttgcaaatattatcgaggactatccaattttagaggaagcaaggcgagttgctagtcagattgttagcgtggaaaattggcaggaggaccctaattggtcgattttgcttgctaatttgaaagatcgagaggaattggactagtcatataaaaaaggccaacacacatgtgttggtcttttgacatattgtatagttcgtcagcgattaaccttggatgtaatctgccaagctttgctcttccaagcctgcattgagagcgataaggagtttgagtcgggctttttgagcattcaattctttaacaaatagaatgccgtctttctccagttggatgccacctccttggtaggcatagacaggctcagcaattccgttaaaacagcgagataccagaataatgggtatcttttgatcaaggagtttcttaatggctggaaggatggtaggcggaagatttccggcgccgagtgcttcaataactaaaccggaaattgagcttgcagtgagtgaatcaaggagaatggagtccatatctgcataagcttttatgattgggaccgttcctgtgactgttgataagtcaaatcgaacacgtggttcagcagttttaaaatagagaatctctcgtttggtgactaatcccagtggtccatgggttggtgtttgaaaggttgagacattggtggtatacgtttttgtaacatatttagcagcatgaatttcatcgttcatgaccactagaacacctttatctgcggatttatcatcagtagccacacgtagggctgttcggtagttataaatcccgtcgctacccagttcatttgaggaacgcatggctccggtcaatacaattggtttttctggaatagccattgtatcaaggaaataggcagtctcttctaaagtatctgtgccatgtgtaatgacaaaaccatcgaagttcatttgttcttctttgattttttggtatagagtcatcatgtgttctaagcgaatgtgtggacttggaacattgagaaaatccaaggatgtcacttgagtttcttctagtgggctatcaatttgggtcattggattggttttattcgctgcaacttcaccctgatgattggtttgcatagaaatggttccacctgtatgcagtactagaatttttttcataaattttcagtttctttcaaagtgtgatatactaattgtaacataattcttagaaagtaggtgagttggttgacgataaaggctgtatttttcgatattgatggtaccttattgaccgacaatcgtatggttagtagttcaactattctcgccattaatgctttgaaagagaaggggattttagttggtctagctacaggacgtgatcctcgttttgttttgcagtatatggctagtttagggctagatttggccattgcttataatggtcaatatattttttcaagagaagaagttatttatagtcagagtttagagccaaagcaaattgaacaaattatggagtatgcgcaaactcaccataaggatttatcttttggaactgctaaaggcatatttggtagtaagattatgagtgctggaacaggaaattttgcatatcgtgtgacgcgtatgattccggagtcctgggctggaatcataaattttattttcaatcgtttggtacgttggattagtcctcaacaggaaacgaatttgaaaggttttctctttcaaccaatctatcagctgatgttgctgacgacggaaagggagacacaatcattggaggtgctctttccgaacttgtcttttacgcgttcgagtccctatgcgactgatattatcagtaagggaaattcaaaattatcgggtattgtaaaggttgcagatcgatatggttttgagttagatgaagttatggtattcggggattctaataatgattttgaaatgttgaatgaaattcagcactcggtagcgatgggaaatgggacgaaaaaggttaaacacgcagcttcctttgttacggatacaaataatcgtgatgggatttataaggcattaattcattttggtgtgattgagggataagatgtttcagagcaaggacgataattttaatagggtaaaggattttcattttttaatggatggtgaaacacaagaacttcccagtgtgtatgatggacagacggctttgtatcgcgctggttttaaattggaggagttggtagaatttctacatgcagcttcagaatctgaagttgagtttcatgattttattcaacaacttcatcaggatttagatactgctgctgctaaggtatctggcaagagaggtttcggggtttcgatgcaggatcaggtagatgctttgctggatattctttattttacatatggttcgtttgttttgatgggggttgatccagaaccaatttttcagatagtccatactgcaaatatggggaaaacatttccagatgggaaggcccattttgatccaattacccataaaattttaaaacctgatgattgggaagaacggtttgctccggaggaaaagattcaggaagagctgaaaagacagatgaaaagacttgattcgtaaatcaagtcttttggtttataaacttttttctccatcgcgaacaatgagtaaatcgatagttgcgtggcgcatgatatattcggatgaggatccgattaggagacgttcaaaggcgtttagaccagttgctccaagtaacataagatccgcaccggtttcctttggaatatcgatagccagtagggttttagggttaccgaattcaatgcgaatctgtacatcggtcagaccggcgttgagagcttcttgtttgtattcttcgaggaggagctccgcctctctttctaaagattcatagacagaggcgtcaaatgcaacaacattgtggagagcacgggtgtcaatcacatgggcgataatcagacgtgcttggttgcgtagtgcaacatgaatggctttatgaagagctaattctgctcctttagagccgtctacagcgacgagtattgttttgtaagattgtgtcataatagtcactcctttcagaagagctttgtcccgaaataggtagagtagttccttacatttttattataagccttttgagagaaaatgtaaaggattcttgtacttttttagcttttacagtacaatagaaaagatagaaagttgaggtgacgacatgaagcaatttaacaagtcaacaaaattggatgatgtagcatatgatattcgtgggcctgttttggaagaggccatgcgcatgcgtgccaatggagagcagattttacgtttgaatacggggaatcctgcagaatttggttttactgctccagatgaagttattcgtgacttgattcataacgcccgtaaatcagagggatattcgaacagtaagggaattttttctgcacgtaaggctatcatgcagtattgtcagctaaagaaatttccaaatgttgacattgaagatatttatcttggaaacggcgtgagtgagctgattgttatgtctatgcaaggtttgctagataatggtgatgaggtgttggtgccaatgccagactatcctctctggactgctgcagttagtttggctggtggtaaagctgttcactatgtttgtgatgaagtagctgaatggtatccagatttggcagatatggagtccaaggtgacttctcgaaccaaggcaattgtccttatcaatccaaataatccaactggtgctctctatccgaaagaaattttaaaaggaatcattgatattgctcgtagacatgaattgatcattttctctgatgagatttatgatcgtatggtctttgatggagctgttcatatccctattgcgacactggctccagatttatttgttgtgacgatgaatggactgtctaaatcacatcgtatttgtggtttccgagtaggttggatggtcttatctggtccgaaaaagcatgtaaaaggttacattgaaggcttgaatatgttgtccaatatgcgtttgtgttcaaacgttttggctcaacaggttgttcaaacttctttgggaggttaccaatcggttgatgagctcttgatgcctggcggacgcttatatgaacaaagggagttcattaccaaggcgattaatgatattccgggactttctgctgtaaaacctaaggctggtctgtatgtattcccaaaaattgatcgtgagatgtacagagttgaggatgatgaacaatttgtattggatttcctcaagcaagaaaaagtacttttggtccatggtcgaggttttaactggaaggatccagatcatttccgtattgtgtatttaccacgtgttgatgagttggcagaaattcaagaaaaaatgtcacgattcttgcggcaatatcgtagataatgggagtgggaaagaactcaaccattcataagaagagttcgtcaacaagtctttatttctagttgttgagctgaaacagtctattcccagactgtttcgctcccacctccgcacagctcaaactgtctgggagacagtttgaggttggagatgaagcgaactctgttcgcatcagtcgtataggtcagattttgaatgtaaaacacgaacgaatctgccaatcaaccactgcgctgagatgttgacactaactttgagaagcggtgctgggctttttgcccagcctatttctttttgcttggatgaaattgtttgtgtttttctaacaacggtaaatattctgataattgttgaaattttatgtattttttgctatactgaaagcaattacagagtaaagaggaaaatatgacaacattattagagaagacacggaatattacttctattttgaagcgttccgaagagcaattggcagaagaattgccttacaatgctattgctgaacatctatcagctattattgattgcaattcttgtattattaatagcgaaggtgaagttttgggataccacatgagttacgagacaaacaatgatcgtgtggaagaatttttccaaaacaaacaattcccagaaggatatgtaaaagcagttgcgcaggtttacgatacgcaggttaatttgcctgtcgagagcgagttgactgccatccctgtcgaatcacgctcgacttatccaaacgggctgacaacgatagcgcctatccacgtaacggggattcgttttggttcgcttattatttggcggaatgatgagcagtttcacgatgatgatttgattttggttgagattgcggcaacagtagttggtattcagttacttaatttccaacgggaagaagacgagaagaatatccgtcgtcgtgcggcagttaatatggcggtaaatacgctatcttactcagaaatgaaggcagttgcagctattttgggtgaattggatggcaatgaggggcaattgactgcttctgtgattgcagatcgtatcggtattacacgatcggtgattgtgaatgcactgcgtaagttggagagtgcagggattattgaaagtcgttctttgggaatgaaggggacttatttgaaagttctcatcccagctatttttgatgaaattaagaaacgtgactactaaaatgacaaaagcattgattatatagtagattttgtggcagatgaaggaaagctgactgctggaaaatcagctcaggctatttctaaacgaattgctcaggttacgcaagaagcttttgaaaatggagactatattttctttgcgattgatggtcatgaggagggggatgaatttcatcctgaagctcagcttttcccaagtcataatatcattgggacgcaagggcgtgacttgtatggtcctttagcagatttttatcaaaaacataaagggcatgcgcgtgttcgttggatggataaacgtcattattctactttttctgggacggatttggatgttcgactaagagaacgtggtgtagatacggttgtcttgacgggtgttttgtctgatatttgtgttcttcatacagctattgatgcttataataaggggtatcgtattgaggtggtctcatcagccattgctgcattgacggaggagaatcatcagtttgctcttaaccatttgcgtcatgtactcggtgcgacaattattgattaatagtatagtgaccagtctgtggactggtttttacaggaatctgtatcattaacactcttcgaaaatcaaactcagaccttgttgacttaacttgtaaaagaagcggtgtgattgaccatgataaatttatcaaaatgctttacataggtgattacttggtgtataatatagtctgtgtgtaatggacgcacaaaaatacagtttatccgctgggtttaaaagcacctaagattgacaaagataggagaataaaatgaatccattgatccaaagtttgacagaaggtcaacttcgtactgacatcccttcattccgtcctggtgacactgtgcgtgttcacgctaaggttgtcgaaggtaaccgcgaacgtatccagattttcgagggtgttgttatctctcgtaaaggtcaaggcatctcagaaatgtacactgtacgtaaaatctctggtggtgtaggtgttgaacgtacattcccaatccacactccacgtgttgataagattgaagtagtacgttacggtaaagtacgtcgtgctaaattgtactacctacgtgcattgcaaggtaaagcagcacgtatcaaagaaatccgtcgttaagatagtcctacagactattttggtcggagaatgggaggcagcgaaagctgtctctttttttaaaaaaaatctgttgaaaaagtaccaaattgtgaaagcataaaatggaaataatatgttatactatatattattgtagcgagtatagaggaggttgcggatgagcgaacagtttattccatctgttttatcagatttacggcaagatattgttcagatgccagaagttatcaaggaatgtagtggaattcgtatttatggtcgtcgcattcgttcagtcttatttacaacggatgtgtctattattgctaatcacaatgcagatgctattttggctgtttatccatttacgcccagtccagctattatcaaaagtattatgttggttgcgtcagttccagtcttggctggtgttggtggaggcttgacgacaggtatgcgttcagctaatatgagtctcttgtctgagtcggagggagcatacgctgttgtggtaaatggaccaacggatgtaaaaacaattgaggcaatcaataaagtagtagatattcctatcatttataccgttgtttctgaaaagtctgatttaacctcacggattaaagctggagtagatattttaaatgtttcttgcggtatggaaacgccaagggttgtgaagaagattcgagaagctttccctgactttccaattattgcgactggtggtccgactgaggactctattcgtcgggttatcgaagctggagccaatgctgtctcctatacagcaccaagtaatggggagctttttaaagggaaaatggaaaaataccgcaaacatgcaaaggattagctcataaaaagataggctaagcaaacagtaagttttattgctagatgaaacttgctgttttttatcgttttacggtgtgagattaggaatacttcgcaatttaaagaatggatttttaggaggaaataggtaacatattaggtcatttctacctttgtctgaggctggaaatatggtataatgagaagatagatttccattaggaggaaagtaagaatgaagatttctgaagctgaagtccgtcacgttgccaagctgtctaagctggaattttcggaccaggaaacagcggaatttgcgacaagtttgagcaagattgtcgatatggttgaattgctcaatgaagtagatacgacaggtgttgcggtaacgaccactatggctgaccgtaagaatgtcttgcgagcagatattgcccaaaaaggtgagagccgtgaggagctctttaaaaatgtgcctgaatcacaagataactttatcaaggtaccagctattctagacgggggaggagatgcctaatgacttttaacaataaaaccattgatgaattgcatgacctccttgtcaaaaaggagatttctgcggttgagttgaccaaggcaactttggaagacatcaaaagccgtgagggagcagtggatgctttcttgactatcacagaagatgcggccttggcgcaggctgctgcccttgatgaaaaagggattgatgcggacaatgttatggcagggattcctttggcagtcaaggacaatatctctactaaggggattttgaccacggcagcttcaaaaatgctttataactacgagccgattttcgatgcgacatcagttgctcaggcctacgcaaaggatatgattattgtcggtaagacaaacatggatgagtttgccatgggtggttctaatgagaactctgccttcaaaccgactaaaaatgcttgggaccagacaaaagttcctggtggttcttcaggtggctcagctgctgctgttgcatctggtcaggtccgtttgtcactcggttctgacacaggtggttccattcgtcaaccagcagcctttaatggtatcgtcggtatgaaaccgacctacggaacggtgtcacgttttggtctgattgcctttggttcatctcttgaccagattggtccattctcacagacagttaaggaaaatgcccagttgctcaatgtcatctctggtcatgatgtcaaggatgcaacatcaacgatcaatgaaattgcagacttcactagcaagattggtcaggacatcaagggcatgaaaatcgctcttccaaaagaatacatgggcgaagggattgatccgcaggtcaaggaaactattctcaaggcggctaagcacttggaaagcttgggagcaatcattgaagaagttagtctgccacattctaagtatggggttgctgtttactatattatcgcatcatcagaggcgtcttctaacttgcagcgttttgacggtatccgctatggtttccgtgcagaagatgcgaccaacttggatgagatttatgtgaaaacccgtagccaaggttttggtgaggaagtcaaacgtcgtattatgttaggtacatttagcttgtcatctggttactacgatgcctacttcaagaaggctggtcaggtgcggaccttgattatccaagattttgaaaaggtctttgcggactatgacttgattttggggccaactgctccgacggttgcctttggtttggacacgctcaaccatgaccctgtggccatgtacttggcggacttgttaacaattcctgtaaacttggcaggtcttcctggtctttctattcctgctggttttgtagaaggcttgccagttggtttgcagttgattggtccaaaatactcagaagagaccatttaccaagtagctgctgcctttgaagcgacgacagactaccacaagcaacaaccagtgatttttggaggtgctaactaatgaactttgaaacgattattggtctagaagtccatgtggagttgaataccaactcgaaaattttctcaccttcatctgcgcattttggtgaggatccaaatgccaataccaacgtgattgactggtctttccctggcgtccttcctgttcttaataagggtgttgtggatgctggtattaaggctgccttggctttgaacatggacattcacaaggacatgcactttgaccgcaagaactatttctatcctgataaccctaaagcctatcagatttctcagtttgacgagccgattggctacaatggctggattgagattgagctagaagatggttcaaccaagaaaatccgtatcgagcgtgcgcacttggaagaggatgcaggtaagaatacccatgggacagacggctattcttatgtggacctcaaccgtcagggcgtgccattgattgagattgtatcagaagcggatatgcgttcgcctgaggaggcctatgcctacttgacagcccttaaagaaatcattcagtacactggtatttcagatgtgaagatggaagagggttctatgcgcgtggatgccaacatctctcttcgtccttatggtcaggagaaattcggtaccaagactgagttgaaaaacctcaactccttcaactatgtgcgcaagggcttgcagcatgaagtagaacgtcaggcgaaaatcttgcgttcaggtggtcaaatccagcaggaaactcgtcgttacgatgaatctactggtgaaaccattctcatgcgtgtcaaggagggttcagctgactaccgttacttccctgagccagacctgccactctatgagattgatgatagctggattgaggaagttcgtgcagaattgccagtctttccaaaggctcgccgtgctcactatgtagaaaacttgggcttgaccgcctatgatgcaggtcaattgacgtctaccaaggccttgtctgacttctttgaagcagcggtggcagcaggtggcgatgccaaacaagtttctaactggttgcagggtgaagtggctcagttcctcaatgctgaaggtaagactattgagcaaatcgccttaacaccagaaaacttggttgagatgattgccttgattgcggatggaaccatttcatctaaaatcgccaagaaagtctttgttcacttggccaaagaaggtggctctgctaaggcttatgttgagaaggctggtttggtgcagatttcagacccagcagtcctcattccgattatccaccaagtctttgcggataacgaagcggctgtagctgacttcaagtctggcaaacgcaatgcagacaaggcttttacaggtttcttgatgaaagcaaccaagggacaagccaatccacaagttgcacaacaactcttggctcaggaattggctaagttgttggattagttttaaaactatagaaactatagaatacaaaaatcactcaaaaagagtggttttttgttgactaaaataataattattattatcatcatgatataaaggtatgagggggaataaatagatatgtcaaaagacttcgatgattttttacgagaacatgaggagaatgtcaataagttaaagaaacgtgataaggaaactgagtcggataaggaaagagcaagagatgaattttctagagattattccagggtaatctattctaattcctttagacggcaacaagggaaaatgcaactgtttgccgttaatggtagagcttttcacaggaacaggctgacacatagttttgaagtggcacagattgcaagggggattgttgattatttgaaaaaaaatacatctaataatattgatatagatttcaattcgatgtctgtcgttgttgaaactggtgcacttgtacacgacattggcaatcccccatttggtcatcatggagaaagaattttaaatgatttggcaaaggatattggttttgaaggaaatgcccaagggttacgggtattaaaaaatattgaaaaaaagtctccagatcataaaggcttaaacttaacatatagaaccctagcttcaattctaaaatattatgttccatatagaaaatcacgaaagactgagaagttcatatacaaagaagattatgaggaatttaaaaagagatttaaagaaatggatgtgtttgtgagaacaattgatgttcaaattgttgatttggcagatgaaattgcttattgtgcacatgacttggaagatgcattggcgagtaactacttcaccattgatcaatttgtatttttgttggaacagaaattgggagaagatcaaacattagaggattttaaggaatggattgaagaggcaaaaaataaggcaaaaagaagtaaatccaatgatgattatgatttttattttagacgagaattgctttctattattgtgaataaattcattgaggatatagacattgtagaacttaatgaaaaagacaagaaaaaattaggaactgatcaggatcaagaactagggctcggtcattataaaaaacttgctggtgcattgaagaaaacaattttcgaaggcgtaacaaattctgacgatattattttatatgaaaatgttgggacgaaagtgttgactagattatttgctttattcatgaatgaagaatataatcgggagagttttttgatgccgatcgaatatcgatttgaaaaagacgatacccaaagtgacaagaaaagaaaagtactagattatatttctggcatgatggacacttacgcaattgagatgtatataaaacattttggtacagatccgttcttagagaaatatgatgcagctatattcaagaaaggaactggtaaaaagctaatagaatgtttagcacaaaatttcttacataaatagccatatgtttaagaaaaccgagagttcgtgttgaattctcgggttttcttatgcacttttagtaagaactctcgcgtattaccagctgggtacccaacttaatcttacgggggtggtggggcgttggacttgttatgatacggtccagtagctgcatagcttcctggcccatttcctcagtgaagacgctgatggaagacagggctggatagacttggcgcgtgatggctgtatcgttaaaggtgatgagttggattctatctggcactgcgatttgacgttcttgtaaagcacgcagggcaccgacagccagagtatcgtttgccatgaaaaaggcagggggtagcttgtcgcctaggtcctcaatagcctggctcatcagctcatatcccgactgggtggagaattttccttgatagatgtagtcttcttggagcatgcccaaggtgtctaggtagtcacgaaaggcagtcaggcgggggtctgttggcagttggtgtccatctgtggtttcttcctgtccgactaggagtccaatatcagtcagaccttgtgaatggaagtggtcgataactgtctgaacagagtgttcaaagtcagttgtgacgcaggagaatccctcggtcagcgtatcagagtccacaaaaatgattttagaagacaggctagatagctctgctatttgtccagaagaaaatttgccaactgcgatgatgccgtccacttcttggaggaggggattggtcaggtcgttgaaggagcggacgatttggtagccgagtaagctggcggtatgctcaatactggcccgaatggagtagtagtagaggtcggccagctcttcgctctcggtgtaccactgaacaataccgatggtgcctttttgttgaggtgcttgttttttgatgtgcttggtgtagcccaattcctgtgccaagttgaaaatgcggtcgcgggtttcttggctgacggatagggtcaggtctcccttgagaacgcgggaaacggtggcagaggaaaggtgggcttgttttgctatgtctttgattgtaaccatgttcttctcctgtttatttgtctctagtatagcataaaaaaacaaaattagtaaaaatttagtaaaaatattgacttttaaattgttgagttgtacaataaaagaaaacgattacaaaatctaggaggttcttatgaacacagaacaactcaagcaggcctttctcgatgtgtttggtcaagaggcagatgcgactttcttctcaccaggtcggattaatttgattggtgagcacacggactacaatggtggtcatgtctttccagcggctattaccttggggacctacggggctgctcgcaaacgtgatgaccaagttttgcgtttctattccgcaaactttgaagaacttggaattatcgaagtggatttgaacaatctggtctttgataaggcggataactggaccaactatgccaagggggttctcaaattcttgaaagaagcagggcatgtcattgatacagggatggaagtctttgtttacggtaacattccaaacggttcaggcttgtcatcatcagcttccttggaactcttgattggcattatcgcagaagagttgtatggacttgaattgactcgacttgatttggtgaaaattgggaaacaaacggaaaatcactttattggtgtcaattctgggatcatggaccagtttgcgatcggtatgggagcagataatcgggcgatttatctagataccaatagcttggagtatgaattggtaccgctagatttgggtgaccatgtgattgtgatcatgaacaccaacaaacgccgtgaattggcagattctaagtacaatgaacgtcgcgcagaatgtgaaaaagcagtggaagaattgaatgctgtcctgaacattcaaactctgggagaattggatgaatggacctttgatcaatatagttatttgattaaggatgaaaatcgtatcaagcgtgcccgccatgctgttttggaaaatcaacggaccttgcaggctcgtaaggccttggaagaaggagatttggctacctttggtcgtctggtcaatgcttcccatgtttccttggaacatgattatgaagtgacaggtttggaattggataccttggctcacacagcttgggagcaagaaggagttcttggtgctcggatgacaggagctggcttcggtggctgtggtattgccattgtccacaaggataaggtggaagccttcaaagaaaatgtcggcaagacctatacagaggttgtgggctatgcaccaagcttctatgtagcggagattgctggaggctctcgcgttttatctcgaaaatagattggagaaatgatgacaggattggtggatcgttttgttgagcaggttattgccaacagtgattttgaggaaatggatgctatctacctgcgaaatcgggtcttggctttggtgggagaccaggttctgactgttcaaacagatttagaggacttgattgaattaaaagatgaactattggcacatggagttcgaactggttttgtgggtgaattgctggaagagcaggacatggttgggtcttgtttgatggatttgatgacaccgagtccgagtcaggtcaatcgtgatttttggcagacctatcaggatagtccagagcaagcgattagtgacttttatgaattgagcaaacgtaatgactatatcaagatggctgcgattgcgaaaaatatctattatccagtttcgacagagtatggggatttggaaatcacgatcaatctgtccaaacctgagaaggatcccaagtctattgcagctgctacgaaagctgaagcaagcaattatcccaaatgcctactctgcatggaaaatgagggctatcagggacggattaatcatcctgcacgcgccaaccaccgcattattcgcttggagcttggacaggaaaagtggggcttccagtattcgccctatgcttactacaatgaacatgctattttcctaaatcaggaacatgtgccgatggttattagtccgcgaacttttgagcagctcttggacttgttggatttgttgccaggttattttgtcggttccaactctgacctccctatctcgggtggctctatcttgacccacaatcactatcagggtgggcggcacagttttgccatggatcaggcgccgatagaacaccagctggtcttcgaaggctttgagtcagtttcggctggcattgtcaaatggcccatgtcggtgattcgcttgagttcagcagacaaaccgtcgcttcttggtttagcggctaagattttggaaaaatggcggagctactcagatgatagcgttcagattaaggctgagacagatggaacaccccatcatacgattaccccaattgctcggaaacgaggcgatttgtacgagctggatttggttctccgcgataatcaaacttcagaagagtttccagatggcatctatcatccacatccagatgtgcaacatatcaagaaagaaaatatcggcttgattgaggtaatgggcttggcgattttacccccacgcttgaaggcagaattggctgaagtagaaaaattcttactgggtcaagatagtcaggtggctgactatcatcagccttgggcggaaagcctgaaaacagctcacccagatgtgacggaagaaactgtcgaacaagtagttcgtgagtcagtgggacaaatctttgcgcgtgtattggaagatgcaggggtctacaaacgtactccagaaggacaggcagcctttctacgattcgtagaatttgtaggtttagcaacataaatgtaagaaagagtgggacggtgtcctgctctttttggtataatggaagtattcacagtgtgagaaggagatatgatggcggaaaagagattggggacactgattacagtaatagcaggtatagcctggggcttgtctggagtgagtggacagtacttgatgtctcgtggtgtttcagtggatatgattacctccctgcgtttgttggtgtcgggactctttctcgttggcctggcttatgctacagcgaaagaacagctattggcagttttgaaagataaaaatgccttgctaggaatttttatctttgccatgcttggcttagttcttaatcagacagcctatttacaagccatctatcataccaatgcgggaacggctactgttctacaatatctctgtcctattttggttttggcatatacctgtttgaaaaatagggaaaaaccatcagggattgagttgatttcaattatcttagctatagcaggcacttttttgattgcgactcatggcaaattagatgaattggcagtgactccaatcggtttgttctggggaatcttctcagcctttacttatgcgctatatattattttgccaggtaaattgattcgtcaatacggcagtataacggtgattggtttagggatgttaatgggtggttttgtagtcacgcttggtttgcaaacttggcagcatcgtcttcctattgatggtggaagtttcctgggcctgttaggtattgtcggagtcgggacgatttttgcctatactgcctttcttaaaggcgtcagtatggttggtcctgtcaatggcagtcttttggcctcgattgagccgattgcatctgtcttttttgcagtatggttggtcaatgaacaattttatgcaattgattttgttggaatgttgttgattttacttgctgttttgcttatttctttaaaagatatattggttgcccaaaagagtattggttaatatactcttttttgttatactaaagaaaaaacttgaaaggaataaagatgattaaagaattttgttccgaaaatcatgtaggtgtgatgaaggccctatccctaggagctaaacggattgagctctgtgataatttggcagtcggagggacgacgccgagttatggagtggtcaaacatgtttgtcaactggcccatgagaatgaagccacagtcatgaccatgattcgccctcgcggtggagatttttgctacgataaagcagaggttgaaatgatggttgaagattgtaaagcagcgattgaactgggggcagatggtctggtttatggtttgttaaccgaggaaaattggttggacgaaccagccttggaaagactgtttgctgtttcgcaggactgtcagattgtctttcacatggcttttgaccaaattcctcgcgaacgccaattcgaggctcttgattggctggtagaacatggagtgacacggattttgatgcgtgggagtctgacagggtctgccttgaacaatgtggaatggttacaggaaattgtcgcctatgcacaaggtaaaattgagattttgattggtggaggattgactgtggacaatgtgccaacgttattagaagcattaccaatcaatcaagtacatggaacgagattattttggtaaggtagctttgaaagtgaaataaattacagagtaataatcgaagtttattcagaaatgtttagaagttaaggtttgtttaagcattggaagatacaatatatttattctttttcatataatctccacggaagcagtcgacatgttcggctgttttcatttttgtttgttaaagtccggtatacagactagaaactgctgcgtctctattgaatcccctacgtaaagaattgagaactgtggctgttgaggtgagtgatttagctttggactatgctgttcgtttagcccaatccttgaatagtactttgcgttatcataattatgatagcttgattgccattgctaaaaccaaaggagtagaaccgaaaggtaaggattgtcaatcattttcagagtacagacagcgttacagtctctatgatgctaagaagttaatttatcgcgctctcgcgtggcgtctattcgatgatagtcatgcagattatggacatgctcttaccattttggggttggatgaggatgagtcaggagtagagcaaatcggttttgctttttcaaaatttactcttgatattgattgattgctaacccatatgattttcattccgaaagattggattttggaagaaggtcagatttaattcacaactaccattacattacctccagaaggcactcggttgatccgagtgttttctgctatcgattcgcatttttcttagaaaaatggtataattatctgataaaaaactttggagacgacagtgagtttagaaaattacatgccggattttgccttggaaaaggcttatgacgtgaccgtcgaaagcttgaaaaaacatggcataaaagtagtgtttgttgacttggataataccttgattgcttggaataatcccgatggtacgccagagatgcgccagtggttacatgatttgcaggacgcaggtattcctgttgtggtggtgtctaacaataaatacgaacgtgtcaaacgggcggttgaaaaatttgggattgaatttgaagccttcgctctcaagcctttcacctttgggattaaccgtgctttgaaacgctttgatgtccagccgtatgaggtaattatgattggcgatcagctgatgacggatattcgggctgctaagcgagctggtctcaagtctgtcttggtcaaacccttgataaagacggactctatcaatacgcagattaaccgttggcgtgagcgacggactatgaaaaaaatcatcgctaaatatggagcgatagactacaagagggagatgtaagtggaagaattattttgtatcggctgtggtgcccagattcagacgctagacaaggctgtcgctggttttacacctcaatcagccctagaaaaaggcctggaaacagggcaactctactgccaacgttgtttccgtttgcgccattacaatgagatttcagatgtcaatatctcagacgatgatttcttgaaactcctccatagcgtaggagaaagcgatgccttggtggttaatgtcattgatatttttgatttcaatgggtcagtcattccaggtttacctcgctttatttctggaaatgacgtgcttttggtcggcaacaagcaggacattttacccaagtctgtcaagacaggcaaggttactcagtggttgaccgagcgggcacatgaaatcggcatgcgaccggttgatgtggtcttgacttcagcccaaaataagcaggctatcaaggatttgattgaaaagattgaacaacaccgcaagggacgggatgtctatgtggtcggcgtgaccaatgtcggcaagtcaaccttgattaacgctattattcaagaaatcacaggggacaaggatgtcattacgacttcacgtttccctggaacgacgctggataagattgaaatccctctggatgatggttcatacatctatgacacgccaggaattatccaccgtcaccagatggcccattatttgacggctaaaaacctcaagtacatcagccctcgcaaggaaatcaagccaaagacctaccagctcaatccagaacaaaccttgttcttggctggtctgggacgatttgactttgtggctggtgaacgccaaggctttacggccttctttgataatgagctccaactccaccgcaccaagttgcagggagctagcgagttttatcagaaacatgcgggctcacttttagtgccaccaaccagcaaggaattgaaagaatttcctgaactggtccgtcatgaatttaccatcaacgagaagacggatgtggtcttctcaggacttggttggattcgtgtcaatgaaaaagccaagattgctgcctgggctcctaagggtgtggatgtggtcattcgcaaggcgattatctaatactcttcgaaaattaaaagcagacgttgttgacttgatttgatgaactccagttctatctgcatctgcgtcgcctagtctgattttaattttcattgagtataagaggtatttgatttcagtttttacaattaaagagaaaggaagttcaagtcttctgatttgaacacgggctaagtatatcggcgcaataaggaaaaactttgttttctttatttcccgattgtaacagtctcccagtctgttacaacgccctttgtgtataataaattatgctaacttcaaaacaacgtgcctttttgaacagtcaggcacacagtctcaaacccatcattcagattgggaaaaatggtctaaatgaccagattaaaaccagtgttcgtcaggcactggatgcgcgtgaattgatcaaggtgaccttgctacaaaatacggatgaaaacatccacgaagtagctgaaatcttggaagaagaaatcggtgtggatacggtccaaaaaatcggtcgcatcttgattttattcaaacaatctagcaagaaagagaaccgtaaaatttccaaacaggtcaaagaaatctaagaaggagagcctatggctattgaactcttaacaccctttaccaaggttgaattagaggttgaaaagaaagaaaccaatcgcaaacaagtggggattctgggagggaatttcaaccctgtccacaatgctcacttgattgtggcagaccaggtccgtcaacagttgaagctggatcaagtcttgctcatgccagaattcattccacctcatgtggataagaaagaaaccattgacgaataccatcgctattccatgctcaagatggctattgcaggtattgagggcttggggattgaaaccattgaactagaacgccgtggtgtcagctatacctacgacaccatgaaattgctgaaggaaaaaaatcctgatacggattattatttcatcatcggtgcagatatggtagactaccttccaaaatggcataggattgatgaattggtccagttggtgcagtttgttggtgtccagcgccctcgttacaaggcagggacgtcctatccggttatctgggtagatgtgcccttgatggacatttcctccagcatggtgcgtagttttatcaagcaaggacgggtgccgaattttatggtgcctcatgaagttctggactatatcgaagaaaaaggactttaccaatgattgcagcagatttgacatttgatcgtcaggctcttttggaaaaaatccgtgtagccatgaagccagcgcgcttccaacatgttttgggtgtggagcaggcggcgcttgtcttggcagaccaatatggctgtgatccgaaaaaagccagtctagcagcactcttgcatgactatgctaaggaagtggaagaccaagtttttttggacttaattgccaagtatgatttggacaaggacctgctcaactgggataataacatctggcacggtgtggttggcgcctataaaatcgcagaagattttggtttggaagatgaggagattttccaagccattcaacgacacaccgttggggcggggcagatgaccttgctggacaaggttctctatgtagcggactacatcgaacccaatcgggattttcctggggtggacgaggcgcgtcgtatcgcaaaagagtccttggacaaggcagtagcctatgaaactgcccaaaccatttcctacttagccaagaaggggattcccatttatccacaaattttggaaacctataatggctatgttgtttggttgaaggagtagggatgattacattatagtcatttagtttttcttttattacttcgttaactcgctttgccgtactccagtacagcctgcagctcattgcctagtactaaaagtaaactaaaaggctataaaatatcttgatgaacgttcctatcaagcagtcttagacttgacagtagccgaggaggacaagggcttcgtggctccaaacgtgcgttccttggcggatgcctggttatatagagagaatgggagtgggaaagaactcgatgggttctaaaagagttcgtcaacaagtccttatttccagttgttgagctgaaacagtctatccccagactgtttcactcccaccccccgcacagctcaaactgtctgggagacagtttgaggttggagatgaagcgaactctgttcgcatcagtcgtagaggccagatttggagtgtgtagcacgaacaaagctgccaatcaaccactgcgctgagatgttgactagaactttgagaagtgtacttgcactagaaccttgccccttatgccatctgggcggatgaacaggtggttggttttgccttgattgacattgatgaagacatccagcagtatatgctctggcgatttatgattggccaagagtttcaaggaaggggctatggccaggcggctttggaagtcgtaatagcaatggctcaatcacatcctgtctgcgaccatttgattgcagcctatgttaagggcaatcagaaaatggctcatctcttggagaaaaataattttgtcttggatagtgaagaagaaagagaattggtcttccgtttggaaacgcctggtgttcagctatgaaatctgcattgttagtcattgacattcagaaccttctagtggaggaaaaaccttatgccattgaagagcgattagccctctggtaagatagccttgcacaagcccgtcaagcggggctagaagtcatccatgtccgccatcatgatcaggaattggtcaaggggactgcttgactgggagattcactcaattgttgcacccttagctagtgagaagattttcgataagtcctttaacagtgccttcaaggaaacggggcttcatgcttatttgcaggaaaaggaaattgagcgactcattatcatgggcatggcgaccaatttttgcattgatacgacgattaaagtagcctttgaactaggctacaaggtagctgtgatccagggcggaacgacgacaggttattcaggtaaattggacgccgaagacttgattgaccactaccaaaacatctggtcatggaattttgcccaggtggatagattagaaaatataattagaggataagatgaaagaactagatttagtaaaagttgtggttcaggctgctgatgacaagcgagctgaggaccttgttgtaattgatgttcaaggcgtgaccagcctgacagactactttgtgattgccagctccatgaacagtcgccagttggaggctattgcggaaaacatccgtgaaaaggtagcggatgttggaatcaagagtagccgtgtagaaggcgatagtaacggtggctgggtcctattggatcttggaggcgtagtcgttcatatcttctcagaagaaatgcgtgacctctacaaccttgaaaaattatggcacgaaggcagcttcttggaagtcgcagactttttagaagaggaatagtgaaacagtttggggaactgtttcagctggtcaccataaaactcgaaagtgaccaaagagagttcactattatgtaattagaagtgatgaacttcttgaaaaaatatgaagatagattttgatttgggtgcactatttgaaacttaagtcaacatctcagcgcagtggttgattggcagctttgttcgtgcttcccactccaaatctgacctaatcaactgtgcgggggcaggaaaacgaactctttggaattgaggagttctttcctgctccctttttatgaaaggaaaaatgggaaaatatggcaacttatgaaacatttgctgcggtctatgatgaaatcatggatgacagcttgtatgataaatggacagattttagcttgcggaacttgccacaagacaccaagacaattttagaattggcctgtgggacagggattcaggctgtacgttttgctcaaaagggctatgaggtgacagggcttgacctgtcctatgaaatgttggaattggcccagaaaaaagcagaagctgctggtgtcatgatggaattggcccaagcagatatgatggctctggaaggtgtgggagatttcgatgcggtgacctgttattcggacagtctgtgctatatgtcggaccgagaagccgttttgcgggtctttgaaggcgttcactcggttctcaatcaaggtggtactttcctttttgacgttcactccatctatcaaatggaggaagtctttgcaggctatagctaccatgaaaactacgaggattttgcctttgtctgggacacctatgagggggagcatgcacattcgattgttcacgaattgaccttctttgtcaaagatgaagccagtcaagaggagcggtttatccgtcgggatgaagtgcatgaagagcggacttatccgattgaaacctatgtggaattattgaaagaagctggttttgcatctgtggaagtctttgcggactttgaagatgaagcaccgacagaaacaagccagcggtggtttttcaagtgtaaaaagtaagatttaaaattaaagtgaagttttcgggtcccaccaaattagagtgggattttgtgatataataaaaataaatatatctgtaaaggaaaatgacatggagagtttacatcgtaaaatcagtaactggggtcaaaaaatattccttcagttcaaaaatagaactcctaatgtggaagggataagttttaatagactgacctctaataaaaatatagatttggaaagggaaaatccaagctttaaacaagcactagattttgcaatccaagatgatgagttaaaaaatgtagcgatcacgggaaattatggctctggaaaaagtagtttgcttgattcttatgaagcgaagtactctaataaaaaattcctccatatttctctagctgactataaagaaaatgatttatcaggctataaagaaaatgattcatcagagtcaggaaagaaactaaatgtacgacagattaatgtgattgaaggcaagatcataaatcaattacttcatcagattcatccaaaacatgtaaagaaatcgatttttaaaacattgtctcgaactccaagaagaataccgcttttattaactgtatatattgtactattcttcattacactttcttattttttgaaacccaattttttaaaagctttagtcactgctgacaaggtatttgggtgggatgccaataccgtatttagctggttatttttgattcttctttttattggctcccttacaacgatttggtatatagttgaaaataagacgataaaatcattgacaattggtggcaaaaatgtttcatcagagattgatattttttctgatcagtcgatgagagtttcctattttgacaaatacctagatgatgtgttgtatcttttgaatgaatcaagagcagatgtcattgtttttgaggatatcgaccgttttgagaataacactatttttgccaagattaaggaactaaacgtattagtcaacaataagcgaaaaatagctaagaaatcatcaaagctagtgtttctttacctgatacgagatgatttattcatttcaaaagaaagaactaaattttttgattttatcatcccagtccttccagttattacgagttcaaactctagcgataagttgacaactactttaaaagaaatgggaataaaatcaggattagcggatgacttcctcttcagaatctcgctttatatagatgatatgagattgcttaataatatctgtaatgaattttattcttatcagcttgaattgacacatgacaagacgggtgagaaaaatgcattggatcttgatttgaaaaaaatatttgcaatgattgtctacaaaaatattttcccgaaagacttttctgagttgcagaataatcaaggttttctatattcattgtttaatgagaaagaagttagaagaagtgaaaaacttacgaagattgatagtgaaaaactgcatttagagaataaactgagaaagattcagagtgagcacattcaagatgaaattgaactctatggaacaatttttaaaattccaaatgggagaaaggttgtcagtgtcaatgacaaatttcaagatgagtttacttcttatcatgattttatttctgaaatgctggtggaaggaagtcgtatcatctcctatgtggattttgatgatgcttaccgtaatgtaggtattaaaacagaaaatatggattcaatttttccagagaaagattctccagagtttaaggaacgccttgatactgtaagaagtcgcaataatagtaaagagttgcaacaaaaaattgcttcattaaatcaaaaacggagctttgttgaaaaacaattgattgcggacatctatactaatcaagaaatacatgaatttgctaagagtagagaagaatttattgatatagaaaaaaatcagcaatttgatattatttacttcttattgaaaaactcttatatagatgaaacctatccagattatttgacctatttttatggcaatgtcttaactaagaatgataaagaatttttgagaaatatttccagtggaagaggtgcaggttttgatttcagactggtaaatatttcaaatatctatcatcatttgcaattaaaggactttagaaatgaagaagttttaaattttgacttgattgaatacatgcttaaaaatttggagttgcagagtcgagaagaaaacttgagtgctatcttattacaagaagataacttggattttttggttgaactggcaaagaaattgtatgatagtaagtctgaaaaatataacttggaacagtttgggcagttgatggagttttggctatctactaatccacaaagatttattgactatatgaagtctacgaaggtggagtatcaagctccactaaagaataagttcattcgagctttgatgaatcaggtgaacttagatagtgttgataatgaaataaaggcgttagtagctcgttatatcaatgaaaataatgatttaatttcaccaaatgaagattttacatcatttttcaaaacaaaccttaaggcaatcaatcttaaattcactcattttagagagcctgatgatgatgctcccagaactacgaccttcttggagcttatcgactttatctttggcaatagtttgtatgagataaataaagaaaatttaagattttttatgcggtggtttaagggaagtactgactggtcagaggaagacttcaagcacaagaattttgaactgcttcatacaaatgataattattcaccgctgctagagtatagtagattgaagataacagactatgtctatgcatatttagagatttgtgaggggactattttagataactcggaatatattgtagaactacttcaaagaaacgaagtttacgagtctggatttaatttgggaacactggaggaagaacgccaaattgatagaattttacagttccttccggataatagtattaatttcaatagcgatgatttccgtcaacttgtagaagaggatattcttgaagaggggaattatcttaccttgctaagtttactagttcaaacttctaaagccgtagtggatactgatattatcttatcttattttaccgagaatcagaattatgataatagtcttatcaactttatcaataatgcaagagatttaaaatttgaagaggatatatttaacttacttgagaaagaagaacaaagaaactttttcaccaaaactgttgagtgtatggagttagatgacaccaaatatgaactcatacttagcacacttggttggcactataccgatacatttaataaaagtggaatagagtcaagtaagcttagaatattaattgatttggaaattatacagtttaactctaagaacattgaatttttcagagataattatccagaggatacactatacctaatcaagaaacacttatcggaatatctagatactaaaagtaaaatatataaggaagatgagttgttagcattacttgatgatgacattatttcggatgatgagaaaactaacattgcagaccatattttaaaaatcagtataaaaaataaacagtattcagaaaaattgactgctcatattttggaaaatcagtttgatgaagaggatttgagttatatcatcagtagtcaattctttgacaaccagtcactgagtttgaaagagctagttaaacaaattgcaattgaaaatcttgatactatagctgaagaattttatgcccaaattagtaataatttaatgagaaagctaatcgctgaaagtcaattaaatacattaaagaaattaatttataattactatgtatatacaccaaatttggatgagaatgagaagcgagagcagttttctaagtatttgaatctatttgctctatcggataatattacagctttaaaggaactcaatgtatttgatgagtgggatagtgtattgaaaacattaaataaaccagggactagatggggacaagtgcaaaaaacaacaataaacttggcatttgcaagatacttagatagtaataattttgtaagctcaattaacgaacgaagtaacgatatccgcttaaatagctacaaggataaaactatacctttgtagacctatgttagactatgatagagttgtcgaattaaaatacaaaaaataggagaaatgcatgtctatttcagggataatagcagaatacaatccctttcacacggggcataaatacctgctggaacaggccgaggggctgaaaattgtcgtcatgtctggcaattttatgcaacggggtgagccagccattgtggataagtggacacgggctcagatggctttggaacacggggcagatcttgttgtcgagatgccctttttggtgtcggtccagtcggctgaccatttcgccaagggagcaatcagcattttacacaggctaggtgtggaaaaactggttttcggtacagaagaaatgctggattatcagaaaattgcggatatctatgtggataagtcggaagagatggaaaattttgtgaaaaacttgccagacaatttctcttatccacagaagacccaggccatgtggcaggaatttgcgggtctaaccttcacaggtgatacgccaaatcatattctggctctggcttatgctaagggggtggctggaacaggcattcagctcagtcctgttcaacggcagggagctggttttcattcggaagaggtggaaacgtcctacgcctcggcgatagctatccgaaagggtgctgaccagctggacttggttcgtgactttttaccgtctgccagtctctttgaagaggcgaccaaggtaagctggagaaactattttcctctgctccgctaccagattacgacccacccagatctcagtcaggtctttcaggtgaacgaagaactagccagtcgtatccgctctgccattgggagcgtagcgaccgtggaggagttagtggaggccgttacgaccaagcgctacaccaaggcgcgggtgcggcgggtgttgacctacatcctgattaatgcggtggaaactcccttaccagatgcggtccatgtgctaggcttctcggctcgaggtcaggcctatctcaagcaggtcaaggagcgagtgggcttggtgacgcggatcggtaaagagccctgggacagcctgacccagcaggcggatttggtctatcaactgggcgctgacgcaatggcagagcagacctatgggcgcgtgccggtgagggtggagtgagaatctgagttgaaaatagaaaatttttataatttttcccttgactctaacgctgggtcatagattatactgctatttatgagaggagattatccatgaaaacagtgaaggaaatgagtcagctttcaggtatcagtgtgcgcacacttcattattacgatgaaataaatttgctgacacctagttttattgcggaaaacggatatcgttactatgataatgaggcgtttgaaaagttgcaagaaatcttactttttcgtgaattggaatttcctctcaaagaaattaaaaaaattgtagggaatgcagcttatgatagagagtcagctttgaaagaccagattagattactggagttgaaaaagaagcacttggaaaaagtcataaagcatgccaagtctttacagcagaagggagaaaattacatgaattttgaagtgtttgataagtctgatttgttggctttccaggaggaagctaaagaaagatggggtaataccgcagcttttcaggagttttctgctaagacgaatcaggaagggtttgctcatataagtgcagaaatgtctggtattatgatggaatttggaaaaatgaagagtttatcagctgatgattctaaagttcataaacaggtagaggttcttaaagcttatattagtgagaatttttataattgtaccaatgaaattctagcaagtctaggacaaatgtatattgcagataaccggtttactcaatttattgatcaagtgggaggagaaggtacagcgtcctttgtcagtcaggcaatagcagtttattgcaaagaataaacgaaagaagtctagtgagaactaggcttttttagtattatgaaaacgctttatatatggtataataaaacatagaataaagatggggatctagtatgacaaagataaaaataatcagcaatccatttcataaaagtattgtttttcaaaagcaacaaccgattacagaagtttgggaggaaattacatttgaatccaatccaaatagtcgtttggtaagggaaaatattcaaaaaggggtgctatcatttcatatccaagaaatagtagatattctggtggcagaatatgatgatggaacagggattgacttgttatttgaaggaaatagtgatgaatttcaggagttgaaaacatttgtccaatcgttaaataattcttctatttctttgaagaaatctgcttatagcttgacaaatgcacgagatattctacctgaagttctttctatttttgataaaactcaggtcattcttcctgaagaacttgaacatgacgcagccatacaaaagtttcaagatgcaacaaaacctcagattccattattggttttgggaaattatagtgcagggaagtctacttttatcaattcattggtaggatatgagttattgcctgccagtgaccaacctacaacagcgaaaattatacaaattgagaaatttgctgaaaaatggattgaaatagaaggaacacttctaagaaataaggtttgtatccgaattgatgaggacggctttgaggttgaaggcgacaggattgatgagacaattatcaaagatttagaatccattcgtcagagtttgccacaaacaactccgcaaatactagcacgggctgtgttggcttatttgaatgctagggaagatagtgatttgaatattatcactgtgaaaacagcgtttaccgatagtccactgtcaaaatcttctcatcgctacatcatatttgatactccaggttccaattcttcgaccaatatggagcatttgcagcttcttcgtgaggctatggcgggtatgagcaatggtttgcctatttttatatcggaatacactagcttagatactgtagacaatgataaactctatcaggaattagaacaaatagacggaattgatttacggtatacaatactagttgttaacaaagcagacactgcggccttatcaacttttcaagatcatcaggtattaaatcaagcccttccaagaaaattatcaacaaaaagagtttatttcctatcctctctaatgggcttggggtcaaaaaccagcggtcttttccaagagccagattatgagagagtttatcaaaaaagtttggctgagtttacagacgcttcaaatccttattatcaacagttgtatacttataatattcttccaactcagcagaaactggctcaggaattgcagtctaaggaggagagaaatcttctctatgccaacagtggactgtacagtttagagtcggaaattgaggttttttcaaccaagtatgcggcttataataaatgtgtacaggcggaccagtatttgcagcatattatttctcaaacgcagtcaatcattgaagattccaagaaaacaattgagcaagaaaaagatcgtttagagaaaaagttggagaaagacaagctggcattggtgaatgatttaaaacgccaacaagctgattttttcaattcctcatcgacggtataccaacaaaacttgaatgagaaagtaagggatgagaaacattatgctccgttacaactgttcataaaagagcgggactctctatggagtaaggcagttgatgattttcaattgaaatcctatcaaaaagaaatggcagaatctcctaagaaagccctaaacaatatcaagaatagtttaggaaaagcctgggataagaaaaatattgaaatcctaggttcagcatttgtaaatggttttaacgatacgggaaaagtgttttcgaaggttgatgactataataaaatgaagaccaaggccaaaggtcaagttcgggatcagttaattacttttgcaaggtttgaatacattaaacaagtggaagaggttggaaaagactttacgactctgtcaattcattattggaaggagcagacaggattgattaaagatagattttctcagctcattggtgatgcgtccgtattgtcagatcaaaagcgggcggctattaaagaaatcattttccaattccagcagccagttttgtaccatgattccaagcaattatttgatcaaaaatcattggtagaaggattccgtttgggagacatccagatatttggtgatgccaacaagatcgatttacaaaagctagaaaaacgctataatagtttgttaaaaactgcttacaagcatatcaatgagcaattgattagtcaccatcaagcgactttttataaatgggttgaagccttattgcatttggtaacggagaatattgtagagtttagtccagaccttcattctacgaatttgttaatacaggacaaccgagtgaagattgaggaattatcaaccaacttgcaaaatctacatgagtattctaaggacttgcacgacttgatggcatggaaagatgatgaggaagtagcaaatggttattaagaagatgataaaaaaagtagctaccaaggcagcagacggtgtttcaaaattatcagaattgagtccagagcagcttgaaaaagtgcaggctcaaatggcgacttatcgggatcaaattcctgatttgtcaggtgaggctgcggaggaatactttaggaaacagttagcaattgctggcgtagaagtctataatgcctatctacctcagttaaaagacctttatcttccgattgacaataaaacggaatttcgtttagaagatgagggagttttgatcgatgaaggcgaatttaagagtggttataatatccgctacatcaacattaccaagtgggtgacggataagcaggaaaatagtttggagaaactggtcagtgtttatgaggtcttgtcaacaactccttgtaatatttctcttgttttccaccgtaaacaggaggaaacatctgtatatttagcggtcactaacactgaaaatgcggatagtaatgcagatgttgatagttaccgcaagcgattggtctcagctatcaagggaaattttccaggtgcagcttggaaagaggaggttggaagaggtagcctgccttgttttgaggactatattccctactcagtagcaacagcttctaatattccaacggagaaatcagagaagttcatcagtcagacaatcgaaaaattattggatggcattgtacctgaaaacaaagaacaagaatacattcttgtcctcctggcaacgccagttttggatgttacagatagaaaattgcatctttctcagatttattctaacctatctccttatgccacttggcagacccagttccaattgacagaatcagattccagaggctcttctgcaactgttggggttaatattggtgccagtgtcggaagccagacaggtcacaatctaacccaaacccattcgcaaggtcaaactgagtcaagaggaactagtgagacggagaccaataccaaaggaagtggttggcaagcaggtgtaaatattaaaatactcaacggaggtcataattggaacaaaagcaaatcaatcgccaaaggcatcaccaatacaataggcaaaacagcctcggttgccaatgccgttgggaaaacagtttctagcagtctaggtgccaattttggagctaattttgctcgaacttccagtgtgactgctaccattgggaaaaatgaaggcattagtcagtcctttgtcaaccaccatgttcagcacgctctaaaaaatttagacaagcagatggagcgtttggaattgtctactgccttgggactatgggatttttctgcctatgttttgagtgaagatccaactattgccaataacgttgcccattcctatttggccttgactcagggagaagaatcgcatctgtcgcaaacagttgtcaatctttggcgtggggatgttcaaatggaacgtgataaggctaaagcactgattgcctacttgagagatttacgccaccctctctttggtttcaacccagaaattctagagattgatgaagaatttgcagtttatccagaaatcgtcacagcagccacgccactgtctggaaaggaattagcctatgctctcaattttcctcagaaatcgattgccggtcttcctgttttagagtgtgctcagtttggtcgtaatatctctacttttgaggagaaagatgatcaggagcaacttcctttgggaaatattttccacatgaatcatgaggaaaatacagcagttcagctttccttaccttccttggcctcccatacatttattacaggtagtacaggtacaggtaagagtaataccgtctatcaattgctcgctcaggctagggaaaaaggaattaaatttttggttgtagagccagctaaaggagaatataagcaggtttttggctcagatgaggatgtggcagtttttggaaccaatccaactatcactcccttattaaaaataaatccattcagcttccctgaaggcattcatatcctagaacatttagaccgtcttgtagaactcttcaatgtttgttggccaatgtatgcagcgatgcctgctgttttgaaaaaagccattgaacaagcctatcaagattgtggctgggatttgatttcgtcagtgaatacttattcaaaaaccattttcccaacgtttgcagatgtcttacggacaatcagagaaattatcgactcgagcgaatacgacaatgataataagggagcctataaaggagctttgctgacacgcttggagtcactgacaacggggatttaccagttgatgtttacagaagatgagatttcatccgagaagttatttgatgaaaatgttatcgtggatttgagtcgtctgggttctagtgagaccaaatcgctgataatgggtctcctcattttaaaaatgcaagaataccgaatggtttctagtcagggtatgaatcagcagctccgccatgtgactgttttagaagaggcccacaatctcttgaaacgtacatcaacagaacaggcaaccgaatctagtaatttacttggaaaaagtgtggagatgttgaccaatgccatcgctgagatgaggacatatggagagggctttattatcgcagatcagtcgccaggtctcttagacttagctgttattcgtaataccaataccaagattattttgcgcttacctgaatattccgatagggagttggttggtaagtctgctaatctaaatgaagaacaaataaatgaattggccaaactgccgaaaggtgtcgcagcagtctatcaaaatgaatggctggaaccagttttatgtaaggtggcaaagtatgactcaactgaaatggtatttcaacaaccaacccaattagtaaggacagaatcaccctatcaccgcttggctattttagaattactgactactagcccaaacctagatagcaccttgtcttttgaagaattacaagaattaactctagcagtaggtcttgatagtttgactcaagtaagaatctttaacttcttacgaacaacatccccagataattttagtatgcatgaactggcgcacattctcgggaaagtatacccagaattagtcgagaaaattcggttgaaagcagaaaaagggttagagccacccgctttgacacaggtacttcagcaggaaattgacagtagtatacctgagacgatcagtgagcaggccagacgggatttagtacagggcttgatgacttgttattatttatttgaactaaaagaccacaaggccatgcaggattggttacgaaatggagacttaatatgatagaaggattgaaaactgttgcggaggcagttaagcctgtcgtaaatgaagttggcaaacgagcgatagatgcctttgaaaagccgatagattcagataagcgattggaagctgcatctgataataaaaccacttttcgctatgatggtctgagcaagcctcaagaatttctagctcaagcccaagggtttcccaaagagatagctaaggatatttacaattctcaggaactcaagcattatatggacataggaatgcgagctgtgcaatttggacagaaagaaaatggggagccacgattttgtcttattccaaaagatttatcgtttgatagagttgtagactcacaggggcgaaccaacgcagagcgattgcaaagtggattactaccgataaaggatggtcaacctttagaagttcaccatatcggtcaaaaaaacggtggtcattatgccttattgacgaaagaagaacacattaagaatgggaataaagaaatgttgcataagccaggtaaatctgatgttgatcatggtttagattttgctagagataagcgatcaattgctaaagtacttatggaggaacaagtatgagtcagttagtagataaaataaaagtagtccaaggtctttatagcggtagccctgctagtgagcaagaagtggcagtggctgagagtaagcttcagttgatatttccagcagagtataaggactatttgaaagagtatggggtgatttcattctatggaacagaatggaatggattgaaaggagatacttggaccgatgtagttgcaaccaccttggaagcgcgtagtctgtatgaaaattttcctaaagagaaatttattttagaggatctacattttgatgatatgcttgttttagcggattcgactggtaaagtctttttgtggcacaatggattagaaaaagagattcattcctcaattgcgtcctatctggaagaatgtgtagccagaaaggacaccccatgattcaacctattatgaaagatattttcttcctgcagcagaagtctgagcctgcgactcagctagatgtgcaggtcggtcaggacttgcaggacactttagcagccaatgctcatgcctgcgtgggcatggcggccaacatgattggcgtcaaaaagcggattatcatcgtcaatatgggttttaccaacctggtcatgtacaatcccgtcctcatcagcaaggccaagccctatcagacagaagagggctgcctgtcgctggaaggtactcgcccgacgacacgctatcaggagattgaagtggagttttttgatgcttcatggaaaaagatcagcctaaagctgacagacttccaagcccagattgttcagcatgaactagatcatttggaagggattatcatctaaatctaccgtcaggtagatttttttgtataaaagtcaaaaaaggtcaaacaaaactattgacttttactgaccaatgatgtaaaataagattcgtaaggtaaagggccttacaaattctttgaacaaaaggtcagtttaggtcaaacaaaaaagtttgaccgacaaattgactaaatggtcagtaaaagacaaacttctaaggaggttgctatgaaagacaggattataccctattaactatttttttatcacaaaaaggtcagttttggtcaataaaaacataacatgaaacgaggtaaaaactatgaacaacaatttcaataactttaacaatatggacgacattttcaatcaactcatgggcaacatgggtggctacagcacagaacgtcgccgttattctatcaatgggcgtgaagtgacaccagaagaatttgctatgtaccgtcagactggtcgcctgccacagacagaagaagtggctcaaacacaggctaaaggtcagataaagtcagacggaattcttgcaaaacttggtcgcaatttgacacaagatgcgcgtgaaggtaagttggatccagtcattggacgaaacaaggaaatccaagaaacctctgaaatcctagctcgccgtacgaaaaataatcctgttttggtcggtgatgctggtgtcggaaagacagcggtagtagaaggattggctcaagccattgtcaatggtgatgtgccagcagccattaagaacaaggaaatcatctccatcgacatttcaggcttggaggctgggactcagtatcgtggagcttttgaggaaaatgtgcagaatcttgtggatgaagtcaaaaaagctggaaatatcattctcttctttgatgaaattcatcagattttgggagctggtagcactggcggagactcaggttccaagggtttagcggatattctcaaaccagctttatcccgtggggaattgacggttatcggtgccactacacaggacgaataccgcaatactattcacaagaatgctgctctggctcgtcgtttcaatgaagtcaaggtcaatgctccgtccgcagaggacacctaccagattttgaaagggattaagccgctttatgaagcccaccacaatattgaattgccagatgaggttttgagagctgcggttgattattccgtccaatatattccacaacgtagcttgcctgataaggctattgacctagtcgatgtgaccgctgcacatttggctgcacaacatcctgtgacagatattcagaccttagaagcagaaatggctgaggcaaaacagttgcagttggaagcagctgaaaaagaggattatgaaaaagccttgaatgaaaaagtccgtattgataagctacaaaaacagattgataatcatacggagcaacagaaagtggtggcgactgttaatgatgtggctcaggcggttgagcggatgacaggaattccagtctctcaaatgggagcttctgacattgaacgactcaaggaattgaaaaatcgtctggcagcaaacgttatcggtcaagacgatgcggtggaagctgtatctcgtgccattcgtcggaatcgtgcaggttttgatgatggcaaccgtccaattggttccttcctctttgttggtccgacaggtgtgggtaagacagagttggcaaaacagttagcactagacttgtttggtaacaaggatgccattattcgtttggatatgtctgaatacagcgatcggacagccgtttccaaattaatcggtaccacagctggctacattggctacgatgacaattcccatactcttaccgagcgcgtccgccgcaatccgtactcaatcgttcttatggatgagattgaaaaagctgatccacaagtgattacccttctcttgcaagtgctagatgatgggcatttgactgatggacagggcaaccaagttaactttaaaaataccattattatcgcgacttctaatgcaggttttggttatggaatggcagaaggtgaagaaaatcaagacatcatggaccgcatcgcaccattcttccgcccagagtttctcaatcgttttaacgcagtcatcgagttcaagcatttggataaagatgatctcaaagccattgtagaattactcttggcccaggtcaataataccctggcgaagaaaggcatccaattaacggtaacggaagctgccaaagaattcttgatggaagaaggctatgacaaggccatgggagcccgtcctctgcgccgtgtgattgaaaatcagattcgtgataaggtgacggatttctatttggatcatgttgatgtcaaatatctggaagcggatgtggttgatggaagcatccaaataaaagagcaaagctttgcttaaaaatagtgaagaatttgaaaaatcggatagaaatatctgattttttcttttttgttattcgctaacaaatgctataaaataggctttctagagcacattaaaactttttttataaaatccttgacaagtgcaaacgtttgcgttaaactatattcgtaaccgacagaaaggaaaacgtttttatgacaaatcgtaccagtggaattttgatgcatattacctcacttccaggtaagtttggtattggtacttttggacagtctgcctatgattttgtagatttcttggtggaaaccaagcaaacctactggcagattttaccactaacaactacaagctatggagattctccttaccagtctttctctgctattgcaggaaatacacacttgatagactttgacctcttggttgaagatggcttattggcaacagaagatttccaagatgtaaattttggagataatcctgaaaaagtagactatgctcttatctatcaagttcgtcgaccaattttggagaaggcagttcaagcatttttacaagatgataagaagaaagctgcttttctagagtttgaaaaggctaactcatcttggttgacagattatgcggagttcatggctatcaaggaatactttggtaataaagctctccaagaatgggaagataaaaaagttgtagctcgcaatgaggaagctcttgataagtaccgcttagaattggcaaatcaaatcgactactacaaagtcacacagtatttcttcttcagccaatggaaacaattgaaagaatatgccaacaaacaccacatcaaaatcatcggagatatgccaatctatgtttctgctgatagcgttgaagtgtggacaaaaccccaactattcaaattggacagtgaacgcaagccgctttatgtagcaggtgtaccagctgataacttctcggcagatggtcaattatggggaaatcctatttacgattggccagaacatgaaaaaacaggctataactggtggatttatcgtatccatgaaagtttcaaactttatgatgtccttcggattgaccatttcaaaggtttctcagacttctggcaagttgatggtaaggcagaggtggcaaaagttggaacttgggaaccaggtcctggctacaatctcttcaaggctgtcaaagaaacacttggagaccttccaatcattgcagaagaccttggaaacattgacgctaaagctcgcaaattgcttgcggattgtggctatccaggcatgaaaatcttagaatttggtttctttgatgtaacaggtaagagtatcgatgctccacaccgttgcattccaaattcagttgcctacactggaactcacgataatgaggttgtcaatggctggtacaacaatcttgatccagaacaacaagaatacgtggatgcctacagcaaccgtaagccgattgaaaaagttagccaagctatgctccgtatgctgtttgcaacagtgagtgatacagctatcgcaaccatgcaagacgtcctagacttgggagaagaaagtcgaatgaatatgccgtcaactatcggtggaaactgggaatggcgcatgaaagctgaagacttgacccaagaacgcaaagacttcttgacaaaaatgacattactataccaacgaggaaatgaaaaccatgactaaatttacaacatttgcagaaacaaatacttcgaagaaattagctgatttgacaaatgaagaaatctatcttcaactgttgaactatgtaaaagatgcagcagcttcaaaaccaaaaaacacaggaaaacgtaaagtttactatatctcagctgagttccttatcggtaaactcttgtcaaacaacttgattaacttgggtgtgtataaagacgttcaagcagaattggcagcagctggtaaatcattggcgcaggttgaagatgttgaaccagaaccatcacttggtaacggtggtttgggacgtctagcttcatgtttcgttgattctatgtcaacacttgctatcaacggtgaaggtgttggtctgaactaccactgtggtcttttccgccaagtatttaagaaaaatgagcaagaagcagagccaaacttctggattgaaaatgattcttggttgattccaacaactatcagctatgatgttccattcaaaaacttcactttgaaatcaaaattggatcgtcttgatattcttggctataaaaaagagactaagaactacctcaatttgtttgatattgagtcagtaaactatgacttgattacagacggtatttcatttgacaagactgatattaaagaaaacttgacactcttcttgtacccagatgattctgataagaatggtgaattgctccgtatctaccaacaatatttcatggtatcaaatgctgctcaacttttgattgatgaagcaattgagcgcggttcaaacttgcatgacttggctgactacgcttatgtgcaaatcaacgatactcacccatcaatggtgattcctgagttgatccgtcttttgactgaaaagcatggtattgaatttgcggaagcagttgccatcgttaagaatatgactggttacacaaaccacactatcttggcggaagcacttgaaaaatggccacttgagttccttgaagaagtggtgccacacttggttgatatcatcaaagaattggatgcccttattcgtgcagaaattaaagacccagcagtccaaatcattgatgaatcaggtcgtgtacacatggctcacatggatatccacttctctaactcagtgaacggtgtagctgcgcttcacacagaaatcctcaaaaactctgaattgaaagctttctacgagctttatccagaaaaattcaacaataaaacaaacggtatcactttccgccgttggttggaatttgccaaccaagaccttgctgattacatcaaagaattgattggcgatgaatacttgacagatgcgactaaacttgaaaaattgcttgcctttgctgatgacaaggaagttcatgctaagttggctgaaatcaagttcaacaataagttggctctcaaacgttaccttaaagacaacaaaggtatcgagctggatgaaaattctattattgatacacaaatcaaacgtttccacgagtacaaacgccaacaaatgaatgccttgtatgttatccataaataccttgaaatcaagaatggtaaccttccgaaacgtaaaatcactgttatcttcggtggtaaagcggcacctgcctacatcattgcacaagacatcattcacttgattctttgcttgtcagagttgatcaacaatgacccagaagtaaataaatacctcaatgttcacttggtagaaaactacaatgtgacagttgctgagaaactcatccctgcaacagacatttcagaacaaatctcattggcttctaaagaagcgtcaggtactggtaacatgaaattcatgctcaacggtgcattgacacttggtacaatggatggtgccaacgttgagattgctgagttggctggtatggataacatctatacatttggtaaagattcagataccatcatcgacttgtacgataaggctggatatgtatctgcggactactacaatggcgatgccaatatcaaacgtgcagttgactttatcgttagcgatgaggtaaaagcacttggtaacgaagaacgtcttggccgtctgcaccatgaattgatttcgaaagactggttcatgaccttgattgacttggctgaatacattgaagtaaaagaacaagtctttgcagactacgaagatcaagattcatggaacaagaaagttgttcataacattgccaaagctggattcttctcatctgaccgtacgattgaacagtacaatgaagatatttggcacagtaactaattgaattccaacaattagtaggaaagttgattgaaccactccaaaacttatcagatcaattcttcctatgtgttgaagaataaaaaccgaccagtttttaccattattggtactctccttagtatataaatgcaaagaatgtctctgcaaaagcagagacattctttttataactataaaattctagaagttttgtacacttgatcaaaaaaatcgaaagtttccttttaccgtttcgccattgatacaaagctaactttgtctggacggtaactaattgttccatactggaaagcttgaccatttgaaagataggtgatgctagtgaccacgacgaccatgtcatagtctcctaagtccatcaattgtttttcttcttcgtttgcaaaacggaaggaaatttcacgtctggaatgagaaattgttaaatggagttcttcttctaagtagcggtaaatagagctttcggcaatttctttgctgagataagggacgaccctacggtcaaaataggaaatgtcatattccaaccgctcaccgtcaattgtccgtacccgactcactcgatagaaatctaccttatcatcaacttcgaaagttgacattaaatcttcttgaccttgaataatataaagcgaagtaagctgggtctgaatttggtgctgtgatcttttgttcaattcgcccgctgttttaatttcagaaagatattggtccttcattagaccatgttcgataacaatagaagatttcccctgtttcttttgaatataaccatccatttcaagaagagatagtgctttgcgaatggtgtccttggagtaggaatacacttccattaattcattttctgtcggtagggcctgtccagttgaccaaacctgctcttcgatttttttcttaatatcttgataaacttttttatacttactcatagtttcctgtctttctacccattagtgtatcataaaagagctagaaaggggcaatacatctattttatttagtagaatatacaacttttacgtaaaagtttaaaatattacggaaaagctattgactaatgcaaacgtttacgctatactattcctataaaagaaaacggttacgcattttcagagagagggggagcaatgaaattactaacaattaatgtccacgcctggttagaagaaaggcaggatgaaaaactagatgttttagcccaaacaatagctgaaaaggcttatgatgtcatcgctcttcaagaggtcaatcagctcataactgctgatttggtaacgaaagacttgaaggcggataattatggcttgattttattagaaaaattaagaaccttgggacaatttgactattcatattattggagcaactcacatatcggctacgataagtacgaagaagggattgcctttcttaccaagttgccagtttatgaagtggatcaattttattgtagtcagaataaatctattgattccatcctatcacgaaaaattatgggattgacggtcttctatcaagaccagttgatcgacctgtattcttgtcacatcaatcttccagggagtgaagaggaagaccagcttgataacattcgtacgattgtggaacggactggcaatagacgttttaagattcttatgggagattttaataccgatgccttctcagatcgagaggcctacgaagcgattacagagctcggtctttatgattcatataatctagcgatggaaaaagaccaggggattacggttgaaaaggctatcgatggctgggctggtcacagtcaggaaaaacgattggattacattttcttaaatcagaaaaaggaagttttatccagcttagtgattttcaatggagagaatcgtccgattatttcagaccattttggtgtggaagttgaaattaatgtataaaatggcacagagccaaaaaataaaggagaaaaaatgaaaaaatttcttagtttcgaattttggcaaaaattcggtaagtgtttaatggtcgtgattgcagttatgcctgcagcaggtctgatggtttctatcggaaactctattccgttaatcagcccagaatcagaactcttgattcgtattgggaatatcattgcccaaatcggttgggggattatcggaaaccttcacttgctctttgccttggctatcggtggaagctgggctaaggaaaaggctggtggtgccttctcagcaggtcttgccttcatccttattaacttgattacaggtcacttctttggagtgacgactgacatgcttgcagatgcagcagcaaccgtaaccactgtttttggaacagagattccagtttcaggctacttcgtcaacatcttgggtcagcctgctctgaacatgggtgtcttcgttggtatcatcgctggttttgtaggggcaacaacctataacaaatactacaattaccgcaaattacctgatgttttgaccttctttaacggtaaacgctttgtaccatttgtggttatctatcgctcagttcttgtagcgctaggattagctatcttttggccagttgttcaaacaggaatcaacagctttggtaaatggattgcaagctcacaggatacagcaccaattcttgcaccttttgtttatggtaccttggaacgtttgcttcttccatttggtttgcaccacatgttgaccattccaatgaactatacatcacttggtggcacctatgacatcttgacaggtgcacaagcaggtacacaagtatttggacaagatccgctctggttggcttggattacagacttgatcaacctcaaagatgctggcgatatggctcagtacaatgaccttcttgcaaacattactccagcccgtttcaaagttggtcaaatgattggttcatcagggattttgatgggattgacttacgctatgtaccgcaatgtggatgaagataaaaaacataagtacaaaggtatgtttatttcttcagcacttgccgtattcttgacaggtgtaacagaaccaattgagtttatgttcatgtttgcagcaatgccactctatgtcgtttatgcttttgtacaaggtgcggcttttgccatggctgacattgtcaacttgcgtatgcactcatttggtaatatcgaattccttacacgtacaccgatggcgatcaaagctggtatcggtatggatgttattaactttatctgggtaacagccctctttgcggttggtatgtacttcattgccaactttatgattaagaaattcaacctagcaacagctggacgcaatggcaactatgatacagaaacaacggatgtggtttcaaactcaaacgtagatactgcggatgccaattcacaagtggttcaaatcatcaacttgcttggtggtcgtgataatatcgcagatgtggatgcttgtatgactcgtcttcgcgttagtgttaaagatgtggcacaggttggagatgaaaatgcttggaaacaggctggtgctatgggcttgattatcaaagactcaggtgttcaagcagtctacggaccaaaagcagatgttctcaaatcagacattcaagacttgctagaatctggcgtagccattcctcgtacggaaattgttgcgacagaagaagttgctcctgagactcagttcaaaggtgtgacggagacagtctactctgttgctgaagggcaagccattgccatcacagaagtgaaagatccggtcttctcacaaaaaatgatgggcgacggttatgcagttgagcctagctcaggcaatgtttacgcaccagtttcaggtattgtaaccagtgtcttcccaaccaaacacgctgtcggtattttgtctgacaagggtgtagaagttttagttcacgttggtttagacacagttgcactaaacggtgctccattctcaactaaggtaacagatggtcaacgtgttgaagcaggggatttgctccttgtcgcagatttggaagccattcgctcagcaggacgtgaaacaactatcgtcgttgccttcacaaacacagctgaaatcaaatctgtcagccttgaaaatcttggacaggtcagtcaagatagccaagttgcgacagtagagttgtaaaaagtaaaaaagattgaaaagatgattgcagtcaactcttttcaatctttttcttttggatagtatgccatcagtatttttctaatttcttcgcttcttttttacctttttcagcgatatggaggaaataaatagaccaagcaaggaaaaataagggaataatgccacttctaaacaatgcgaatggggtttcaaagagaaaaccaaaccaaaaactggtaccagttcgttcccatagtcctggagttaggtaccaggatttaggattccaaagtgtgtatccattttggagtccaacttggtaatggataaaaaataaagtcagaaataatccgaaataggagtaggcataattttggtagcgtgaatagaatgcttttttcgattcggtatcagaaaaaatttctgtgcttgaagtttcgattgtttgttgaaaataatggatgccacatctacgactaccttgtataggttgccaaccacagtcttcaaatagagagaggtaatttgaatattctccttttgcaatatgttcatgaaaatcaaggcgtacgggatgaggggttcgactacatttttcaaaatgataggttgctgtccacggagttactttgacaagctgataaccttcggattgaatcgaattgatccaatgttcttcctcttgtaaactggtgaataatttgtgtcttatcatggcttcctccttaaaaacctaattctttggcaatatgatgtagtttttgaatacgctgtgtttccagtttaataatctcttggcccgttgctgttacttgatagacttttcttcttttatcggaacttggaacagaacaaatccattttagtttcaaaagattctcaatcgctccatacatggttcctgcagcgattttcacatcaccatcactcatatcctctactttttgcatgatatggtagccatgggcaggttccaagagggctaatagaatatagtaggttgtctccgttaaggggagatgcttgttccttttcatttggtttctcctatgtagttcaaatgtatagttgtattatatattatatatcggggaactatacatgtcaactgtatagtgaagaagattttaaaaatcttctcaatccttgccatttatggtataataaagcgattttataaaatgtaggaggttccccatgggacgtaaatgggccaatattgtagccaagaaaaccgcaaaagacggtgctaactcaaaagtttacgccaaatttggtgttgaaatctatgtagcagcgaaaaagggtgacccagatccagaaacaaactcagcgctgaaatttgttatcgaccgtgctaagcaagcgcaggttccaaaacacatcattgacaaggccattgacaaggcaaaaggaaacacagacgaaaccttcgtggaaggtcgttacgaaggctttggaccaaatggttctatgattatcgttgatactttgacatcaaacgtaaaccgtacggcagctaacgtgcgttctgcttttggtaaaaacggcggtaacatgggtgcatctggttctgtatcattcatgtttgataaaaaaggtgtggttgtctttgctggtgatgatgcagatgcgatcttcgaattgctccttgaagcagatgtcgaagtggatgacgtagaagcagaagacggcacaatcactatctatacagctccaactgatttgcacaaggcaatcgtggcacttaaagaatcaggaatccaagagttcaacgtcactgaacttgaaatgatcccacaatcagaagtatcacttgaaggcgatgacctcgcaacatttgaaaaactctacgatgccctagaagacgacgaagacgtccaaaaaatctacacaaatgtagatgggttttaatataaaaaaagtgctagtagcactttttttatattaaaaggttggagattggaatcgtcggtagacgattctcattgtacgtgggacgtcctagaaggttggagattggaactgccgttaggcagttttctttgtatccaattgctcaaagacgatagttggttggaactagagaagtggggatattttagcttaagtttgaataaggtacgatggaaaaatttgcggagttttcggtggctgatagtagagtgcttgatagatgaggtataaggaaaaactatagccaggctttggaaatatctatttgaatggtcacgggttttctgttatcatagaacggtaataagattaggagaatgtatgtcaaataatttacttgttttacaatcagattttggtttagttgatggtgcagtttcagcgatgattggtgttgctctccaagaatcgagagatttagttgttcaccatctaactcatgatattactccgtacaatatctttgagggttcatatcgcctctttcaaacggtcgaatactggccggagggaacaacatttgtttcggttgtcgatccgggagttggttcaaaacgtaagagtgtagtagctttgaccgaacaaaatcactacattgtaacgccagataatgggacgctatccttcatcaaaaaatatgtggggataaaggcggttcgagaaatttcagaggtggccaatcgccgtgccaatacagaacattcgtacaccttccatggtcgagatgtttatgcctatacgggagctaaattggcttctggacacattagctttgaagaagttggtccagaattaagcgtggataagattgtggaaattccaacagtcccaacggaagttggttcggactatgtaaaaggtgcaattgatattctggatgttcgatttggctcgctttggacctcgattacgagggaagaattttacaccttgcaaccgcagtttgaagatcgctttgaagtgaccatatacaataacgacatgcttgtgtatcaaaaccaagtaacctatggcaagtcctttgcggatgtacgtatcggacagccattgatttatatcaattccctctatcgtgtaggtgttgcgattaatcagggctcatttgccaaggcttataatgtcggtgtaggtcaaaactggcatattgaaatcaaacgtattagtaattaaagaaattttaggagatagttatgaaaaataattcaatcaaaacagtcgttgctactggtatcggcgcagccctctttgtggttattggtcatttaatcaatattccaacctttgtcccaaatacttctatccagcttcaatacgctgttcaatcgctattggcagttgtatttggtcctgtggttggcttcttggtcggtttcattgggcacacgcttaaggattcgttgacttacggtccatggtggtcatggattttggcatcaggggtctttggtttggttgttggtcttaccaaaaaacgtctgcgtattcaagaagggatttttgaagggaaggatattcttttctttaaccttgttcagattgcggcgaatgtgcttgcttggggagtcattgccccagttttagatattcttatctatagtgaggcggcgaataaggtctttgcacagggacttgtagcaggtattgcaaacagtattacaattgctattgcagggacactccttttggttgtttatgcaaaatctcaaacgaagacaggtagtttgtctaaagattaagtttttattttccctagaaaaaattctagggttttttcaataccaaaaaatacatatatgatataataatataaaacaaacaaaaacatgtgttcaaggggagaagtatggtctggacagaagaaaagttgggaccgattattcattctatactcaatcctgacgaggaagttttaagtctttatcaatcgaaaacgacgaaatcaatttatggatgtattctttggaataattattattataaggtttttcgagttagtaaccacccatcacaatctacatataaacagccgactttttatgatttccatggcgaattttatatgaaaggagcgattcggacctacctttatcacacgaacagttggtatgaacttagtaaacaaggctattaccttcttctcttttttcaaaagttatgggatgaaaagcaagaggtggaggcgagttggcaaaatggtaggatgcagattcgcttagtggttgaagaagaggggtggcaagttcattaccgttttccagataatcaggcaagggaggttgaacgcttattgggctcaggcatgctggtggccattcgctcctccagaaattttatcaagatacggacgagtcgttttgttgcaccgtatatagctctaatcaaacagcgtcaactttatcgaaaaaagccgagtaaagctatgctccagtgggaaaaataccaaagtcaacttattgaaatccaaaggacctatcggctagtggaggaaagtgctccgcaaactttttttggacactggttgaataaggtccaactctatctctgctctgccattgccagctattgggaagaagttattaaaggagtggagtggcaggaggcaagagaaatcaaagagcaaaggaaagccgagaagccacataatcctattgaagataaatggaaggaaaatattgctagacgccataagcgaaaaatggaccaacttatcggacatgataccttggaaaaactccgacaactgaaaacagaattagacgactaagaagttatagcgaaccttcaataaatgcagtagcatgtcattcatgttaccgtatttttttacatataagcactgaacctgcgaatacaggttctaaattttcagttcagatttttgtcttttgaggggctaaacgatataatacgtaaggtatcatttattagaaatgacagagttttatcatctattgcaaagattgaaaaggagacactatgtcaaaagatattcgcgttctactctattacaagtatgttccaattgaaaatgccaaagaatatgctgctgagcatctagctttctgtaagtctatcggactaaaaggacgtattttgattgctgatgagggaatcaacggtactgtttctggtgactatgaaacaactcaaaagtacatggactacgttcatgcaaacccattgttcagcgatttgtggtttaagattgatgaagaaaatgagcaagctttcaagaaaatgtttgttcgttataaaaaagaaattgttcaccttggtttagaagacaacgactttgacaacgatattgacccactcgtgacaacaggtgcctacctatcaccaaaagagttcaaagaagctctcttggacgaagatacagttgttttggatacacgcaatgactatgagtatgaccttggtcacttccgtggtgcgatccgtccagacatccgcaacttccgtgagttgccacaatgggtccgtgataacaaagagaaattcatggacaagcgcgtagttgtttattgtactggtggtgttcgctgtgaaaaattctcaggctggatggttcgtgaaggctacaaggatgtcggtcagctccacggtggtatcgcaacctatggtaaagacccagaagttcgtggtgaattgtgggatgggaagatgtatgtctttgacgagcgtatcgcggtcgatgttaaccatgttaacccagttgtcgttggtaaggactggttcgatggcacaccatgtgagcgctatgtcaactgtggcaatccattctgtaaccgtcgtattttgacatcagaagagaatgagcacaagtatgttcgtggctgttcagctgaatgccgtgctcatgagcgcaaccgttacatctctgaaaacggcttgactcgtcaagaatgggcagaacgcttggaagcgattggggaaactcttactccagcaaatgcttagtaataccaaaattgcattgaaaaatcagtgcaatttttttgtgcaatcagaattctttatattttttcagtccattctatacgaagcctatcaattagaaaagagaaggagatgaagtcattttggatgaacttatccccttcgaaaatcaacattatccgttgtcaacttgccttgatgaacttcagttctatcttcggcttcgtttcctcggtcacttttgattttcattgagtattagcagtagcagaccttgaatagctggtcggttttatgaagcaatcggttttgcagttgcgacgtttggagatattaagtctgcgactttgcctaagggtggcaacttgattttgatgcaggcagatagctttgctcaacgcgtaccatttcaggtagtagcgagtggcaatgaagtcttgatttcgcttaatgtggcgagtagggaagaagtagatagaattatcgagcgtgttgaagcaaatggcgggcaaattacaggatgcccgacagatgcccgtggcttttatggagcaagttttacggaccttgatggtatcattttaatgtgattgtgatgtaggaagttagaattcatctgctctagaatcatagatgaacttatttgaaaagggagaaactgatgattcttcctttttttcagagtcaatttacgctataatagtcctatgaaaaaaatcattgagtttaaagattttacatttaaataccaagcgcaacaggaacccactttaaaagatattcagttaacgatttatcagggagagaaagttctgattattggcccatctggttcaggaaagtcgacgattggacaatgtcttaatggtattattcccaatatttacaagggagaacatagcggaagtttactattggatggtcaggaagcatttaatctttcagtttatgataagtccttgctcgtatcaacggttctccaagatacagatggtcaattcattggcttatcagttgccgaggacctagcttttgctttggaaaacgacatggaaagccaggtggtgatgaagcaaaaagtaggagattgggcagaaagactgtctttgaccgatttgctggcacatcgaccacaagatttatctggaggtcaaaagcaacgtgtcagtctgggcggagttcttattgatgagagtcctattttgttgtttgatgagccacttgctaatttagaccccaaatcgggccaagatacgattgatttgattgaccgtctgcacaagcaagaagggaccacaaccattattatcgaacaccgtttagaggacgtactgtatcgtcaggtggaccgagttgtattgattaatgatggtcggattttgttcaatggaggaccggatgatttattacgtacctcattgttacaggaaaacggcatccgtgaacccttatatctatcgactcttcgcgccttaggatatccgattgcgcaggcagaacgcctctcttcagtttgggaaattgatattgaggctttgaatatagcatccctaccgactctacactttgaaaatggagagaaagaggctttgttagaagtcaagcatctttatttttcctatcctaacaaacaagttcttacagacattcaactgacgattcataagggggaacgtctagctattgttggaaaaaatggtgctgggaaatctactttagcaaaggtgctttgtggttttattcagggtgagggtgagattctctggaaggggcagtcaatcaaagaagattctgtcaaagagcgagcagaacggattggttatgttcttcagaatcccaaccaaatgattagccaaacgatgatctttgatgaggttgctcttggtttgcgcatgcgaggggtgacagaagaagaaattgaacaccgagttcaccatatcttgaaagtatgtggcctgtatccgtttcgtaattggccgatttcggcactttcctatgggcagaaaaaacgggtaacgatagcatctatcttggttctcaatccagaaattattttgctagatgagccaacagcaggacaagatcaacgacattatcgggaaatgatggagtttttggatcaattaaatgctcaagggcacaccattgtcatgattacccatgacatgcaactcatgctagattattcagatagagctgttgttgtggtggatgggcagattattgaagatgccagtccagcagaaattttatctgatgatacggtgattgagcgagccaatttaaaagaaacatcaatttttcacttggcggagagggtgggagttaatcccttagaattaacgacgttttatatgcaggaagaaaggagaggaagatgagtcaacaaaaactaattggttaccatccaggaactggcttgattcatagtttatcggctgtcagtaaattactcttttttctcatagtttccattcttgctatgattacttacgatacccgcttgattctttttatcgcagtattttctctagccttgtttaaaatgtcagggattcgttataaagaaatctctcttgttttaattctgacaatcatttttgctgcaatgaatgccctgatggttcacttgtttgcaccacggtatggagtggaactttacggagcagacactcccttgctatcaggtctgggagtttattccttgacgagtcagcaagcattttatctggtgaatcttctcttgaagtatttttgtacagttcctttagcgattatctttctcatgaccactcatcctagccagtttgcttccagcttgaatcaaattggggtatcctacaaagttgcttacgccgtcagtttgaccatgcgttatattccagatattcaagaagagttttatacgattcgaatgtctcaagaagcgcgtggtttggaattgtctaagaaaggaaaattgatggatcgtataaaagggaatctatcccttgtcattcctctgattttcagctccttggagaggattgatacgatttcaacggctatggaattgcgacgttttggaaaaaataaaaaaagaacatggtatacccaacagcctctacagagaatagattacgctgtcttgctatttattcttgctctagtagtggtgacaatctatctattttttgttaatcaggggcgattctataatccgtggcgatgattattgagtttattggacttatcaaccctttatcgttgacatataggaaatatactgttacagtagggaatgtaaataaatttagagtttaagtatcagtttcatcttttgtttttcctcttgataagttttacaaataaataaaaagaggtaacacaaatggtacaaggtacagttaaatggtttaatgcagaaaagggatttggttttattgctcaagaaaacggtccagatgtatttgcacacttttctgaaattcagtctaatggtttcaaatcgttggaagatggtcaaaaagtgacatttgaagtggagcaaggccaacgtggtcttcaagcaaccaatattacaaaaattggataataaaagagcgggtttcttagtgaaactcgctcttcttatgtttaaaggggtcttttatttggcataccagctttgcgtggaaacttatttggagtttcctttttcttttcgacgatggtcaatgttcgagggtcgccatttggaagagtatagtcgtggttttcgatgacttttgcgaagaggagattgagtgcgttttttgcttgggtcaattcatcttctgcgctggacgccttaagtgcgattaattttccgtggagcttcaaataaggaatagtcaattcagaaagaatctgcatgcgggcaactgcgcgtgctgtgacaaggtcaaattgtgcacggaagttcttatcttgtgcaaagtcttctgcacgaccatgatagaaatgaacaccttcaagctctagttcttcggcaagcaaatgtaaaaagttaattcgtttattaagagaatcaatgatggtaacatctagttgcggaaagatgatcttcataggtaggctaggaaatccagctccagctccaatatctaaaagccgaagaggttcgttctgaatatggccttgcaggagtggagcgatagaatcgtagaaatgcttcagatagacttcgctttcctcggtaatagctgtcagattgattttttcattccattccactaatagttggaaatagcgatgaaattggtgtttttgttggtcagttaattgaataccttggtctgccaaggttttataaaatacttcaggtttcataatcttatcttatcataatttaagcaaaagaaaaacccagaagagtctgggaattttcttattgaccatctgtctgtcccgttgcgggattgtttcctgttgttgcagtttcagttgaagaagttgcagtctcggttgcagttccagatgatgtttcgcttgatgttgtcgtcgcttcggttgtttcactagtttcagtcgaactagaagaacttgtactagagctagtgtaagtattataagcattggagagtgagcgactacctctgagatagtagttggaaccgtaacgtacgagtccgcttggcatctcccaatcggtagctgtatagtccgaatgcataaagagcatcatattgtggtagacatctgttgcaattcgcatgctgttatcaaggataggagtcatacgattggtatatccggtccaaacagccattgcgtactgactagaatatccaacgaagttttcatcaggaacgaccatgtagctataatttgcttctggaattgaagctagaatagtatccgtttcgctatcggtatagtttgatgtacctgttttaccggccataggaacaccactaacagaagcgtttaatccataaccgtaagacataacagccttcatcatgtcggtcatcatgtaggctgtttcggcagacatgactttggtccctttaggagcatattctgttactgttccatcactaaagacaattttattgacatactgtggagcgtagtaagtaccaccattggcaaaagcagcgtaggcagcagccattttttcactacttgctccatacttactgctagtatcggatgtattacttgaaatagcattagagtaatgaatatctggataattgataccaacgctattcaaaaatttcaaggcattttctaagcccgtagcttccaatgctttaacggcggtaacatttcgagaatactgaatggcagtcttaacagagatattaccgtagtattgtttatcccagttattgacaggagttggtgtaccaggatagttataaggaccgtctaagattaaatctgctgtagatgtataaatgccgttttcaaaagcaggagcatagtctgtgattggcttcattgtagaaccgaagtcacggttggtttcaacggcttggttggtaccaaatgagacgtttgtttcttgtttacgaccccctaattgcgcaacgactttaccattagaaacatccacaaccgttgaagctacctgcaataaatcatctggatagctgacatacatatctgtattgtagatattccaaagttgctgctgggcggcaggatcgacgttcgtatagacatccatccctgttgtcagcaagttgtaacctgtttttgcttcaacttcttcaacgacttgtttcagatagttgtccatataagcaggataagcagctgcattagatagtggttgcaaaccatctgttacaggtgttagaacagcttgttcatactgggtattatcaatgtacttttcttccagcatctcagccaataccaaatcgcgacgtgcttttgcatcttctggattggtataaggatcatattggtttggcgcttggggcattcctgctaaaagagctaattgaggaagagtcaaatcttttaactcttttccataaaaagcaagagcagcagtcttcataccgtaattaccgtttgacatatacaccttgttgatgtagtaggtcaaaatctcttgtttggtattgcgacgttccaattgagtagctagccaagcctcttgaattttccgttttagattttgatcttctacggatgtcgagaaataagtcagcttgataaactgctggtcaagtgtcgagccaccctgcaaacgtcctccgctcaagttattaatcagggaacctgcaatacgaatcacgtcaactcctctatgattgaagaaacgttggtcttcgattgcgacaatcgcatttaccaagtctgttggaatttcttcagtcttggcactcgaacgtttttctgctcctaaatctgcaataagatttccgttcttatcataaattttacttgacacagttgctgtcaaagattcttctgtcaattctggagcgctttggatgtagtaaacaaccaatgcagctccggccaggcaggcaatgatagcccccgcaagtaaaatatttgcagtgattagaagagcttttttaattgttgtagttttcaaaagattcaccacctaatagatttttttcaacgatttccagatatgggatgctggggaaacgccccatttgaatctcaaagccgtattgtcgaataaaggttagaggcatcgacttactacccatgtctacttgataaaattcgatcaaatgagtggctggcaagagataggtttcttttaatgttgaaaagtgaagaaggacaaaacaaataccaccttgtttaacaacctgtttcatgtgttcaatctgatgcgcatgaaaatttttcatgggcatggatgctttttggcgtgtctctttcgcttcaaaatcaatataatgtcttttaaaaacaccagagtagtctgtggtagatgcctgtcgaaagtatgcttcgacaatcttagcacggctccgtttggggtaatcaacttttacaatttgcacgggagttggcttcttgtgaatgacagcaatatcgtgcgcaaggtaatattgattgctatcgttgatagcggcctcaaaagacattccgcgattagcaaagtttactcgctgggatgaaataggactggttctattgattttttttgacaccttatgaggataattgaccatagaactccttcttgataaaataatatcagcatattataccataattagcgaaaagagtacaagaaatggatactaagagccttttggtaacaggttatagacatacagacctgggaattttttcagaaaaagatcctcgactgcacattattaaatctgcaattcgtaggaattttattcgttttttagaagagggtgttagttggtttatactgacaggtcaattgggttttgaatactggtccttagaagtcttagaagatttgcgagccgaggggtatcaactgagtattgcaacaatatttccatttgaaaatcatggcgaacagtggaatgaggctaaccaagcaaagttagcacggtttaagcaggttgattttgtaaagtatgcctatccacgctatgaaaacccagggcaatttagagactataaccagtttttactggataatacgacaggttgttatttgttttacgattctgaaaatgaaaccaatttgaaatatttatatcacatggtcttaaagaaagaaggatataatagaaaaacgcttacctttgaggaattgaatgaggaggctgaaaatttttcaaattctgagtgatttgacttgatttttccctattttttttaatataataggagtagtgacgttttagattagggagagagagatggcaagtattaaatttacgacaaaagatattttcgagcaagattttaaaattggttttcgtggctatgatcaagatgaagtgaacgattttcttgatgatattatgaaagactatgatgcttatgaagcgattatcaaggaattaaaaggcgaaattgctcgattgaaagcgcaggcagcaaattctcccaaaacaactcttcctactgaagaatcgaacgatgtattgcgtacagaacgtccatcttcagcgacaaactttgatattctccgccgtctgaatcgtctggagaaagaagtatttggaaaacaaatcgttcaggatcaagaatagaaaattgtacacctaaactgacactttattcgcagttattttcttgtgcacaaatacattctgtatttgtgtcagagatattccttgatttaaagtggcttgctttgtagatacaacttctaagataattaaggtgcaatttttggataatcgcgtggtagttttctaccatgaggaaagtccatgctagcactggctgagatgccagtagtgtttgtgctaggcgaatcaataagcctagggacgcccttgggcgttacggcggttaaaatggctaagtcttttgatatgtcagagtagatctgaaagtgccacagtgacgaagtttttatggaaacgtaaaaaatggaacgcggtaaacccctcaagctagcaacccaaactttggtcggggcatgggatggatggaaatgaacagaaatcctgactgtttagacagtagacagatgattatcgaaggtggtagaacctagtaccactggaacaaaacatggcttacagaaaattgcataaaataggtagctagctctgctagcttttattgtagaggaaaaaaatgaaaaaacaatttgagttgattgcaacggcagcagctggtctggaagcggttgtgggtcgagaaattcgtaatctcggctatgaatgccaagtggaaaatggccgtgttagattccaaggagatgtaaaatccattatcgaaaccaatatctggctgcgttcagcagatagaattaaaatcattgttggacaatttccagcaaagacttttgaagagttgttccaaggagtttttaacttggattgggaaaattacttgcctctaggctgcaagttccccatttccaaggccaaatgtgtcaaatcgaaattgcataatgaaccaagtgtgcaggctatttctaagaaagcagttgtaaagaaactgcagaaacacttctctcgtcccgaaggggttcccttgcaagagatgggggcagagtttaaaattgaagtgtcgattttgaaagatgtggcgacagtcatgattgatacgacaggttctagtttgttcaaacgtggttatcgggtggaaaaaggtggcgcaccaatcaaagaaaatatggcagctgctattttgcaattatcgaattggtatccagataaaccgcttattgaccctacttgcggatcgggaactttctgtattgaggcagctatgttggctaaaaatatagccccaggtttgaagagaagttttgcatttgaggaatggccgtgggttgaggatcaattggtggttgcattacgcaaagaagcacaagcttctatcaaaacagatttggtattagatattactggatcagatattgatgctcgtatgattgaaattgcgaagaagaatgcatttgcggcaggagttgagcaggatattgttttcaagcaaatgcgtgtgcaagacttgcgtacagataaaattaatggtgtcattatttctaatccaccttacggagaacgtttgttggatgatgaagccattgttaccctgtatcgagaaatgggggagacttttgaaccactcaaaacatggtctaagtttattctaactagtgatgagttgtttgaaacccgttttggacagcaagcggataagaagcgcaaactgtataatgggaccctaaaagtggatctttatcaattttttggtcaacgagtgaaacgtcaagtgcaagaagtgcaaggataggaggacatcgtgggagaaaaaaatagtcatcatcttcctttggatgaggagaaagttttagattttgaagtggcgaaagatttaacaatcgaagaagcagtcaaaaaacataaggagattgaagcgggtgtgacagaagatgatggtctcttggatcgttacatcaagcaacaccgcgcagaaattgaatctcaaaaatttgaaaccaaaatcaatcatcttcctttagttgaggtggctgatgaggaaaaaaatcaaggacatgaaagcgcggaagaggtagaagcaaatgagtcttctcttacggaagttagtgaggagattgctcctattgtagaagaactttcggtaactccgatggaaaccttggaagaaacagtgattgcaagtaccgtagcaatggaggggttatcttcagtggcagatgattctagtttagaattggaagaagatgaaaccgaagacttggaccatagtgagggcgcagatagggatcagaaaaagaaattttacttctggtcagcagtagggctttcaatgattggtgtaatggcgacggcgctggtttggatgaattcggttaacaaatcgaatactgcgacttcttcaagttcaacaagtacaagccagacgtcatcaacagcatcaagttcgacagatgcgaatgtgacagcttttgaacagctctataatagtttctttacggatagtagtttgaccaagctaaaaaattcagagtttggtaaattagcagaactgaaagtgctgttggaaaaattggataagaattcggacagttataccaaagctaaagaacagtatgatcatcttgaaaaagccattgcagccattcaggccattaatggtcagtttgataaagaagtcgttgttaatggtgaaattgatacaacggcgacggttaaatcaggagaatctctttctgcgacaacgacagggattagtgcggttgacagtctattggcatcggtcgtgaattttggtcgttcacaacaggaagtcgcttcggctacggtagcaagtgaggctgcagttacaagaaaccaaggtgctgatgaaactgtatctactggtgtaccagcgacaacagaagtcgcttcaacaacggtttcaggctcaacaaccgactttggtattgccgtgccagctggtgtcgtcttgcaacgtgaccgcagtcgtgttccttataatcaagcgatgattgatgatgtaaacaatgaagcatggaatttcaatccaggtattcttgaaaatattgtgactatctcgcaacaacgtgggtatataacaggcaatcaatatatcttggaaaaagttaatattatcaacggcaatggctactacaatatgtttaaaccagatgggacctacttgttctctataaattgtaagacaggctactttgtcggtaatggtgctggtcattctgatgccttggattattaaacaaaaaagcggtttatctgcttcggattgaagaaaaagttcattttggacaatttccttcaatcttttttctttgtgttgaaaatatagtcatttgaattaactttgatacatcgtcactttcggcttgccgtactctgcagaagtgacttgctttgcaagttatatctccaacctagcacagccactaggctgtgctagcaacctgcacctcggttccttgtctgaaagctaattcattcgactataaaaaaactctcagaaacgccgaaatatcaatgtttctaagagtttaatgatttgctatctttcgcaaacttcttcaattttatatatttttaggagtttgtctacgttctgagcggtgtatccgctttttttgttagattggttttctttcaaaggcatctgtagagattccctgagaaaggattagtttggcccattctttagctgaatgaaggctgtggtctttgtagttaccacatgattcaatggttgtcccaggaacatcctcccaagtgatgccttctgcaatttcttccaaactcgacttgatgacttgagcaatcttttcagagtcttgttttccccacataatcatgtggaaacctgtccgacacccgaaaggagagcagtcgattagcccatcgatgcgctggcgaattagtttagctaatagatgctcgatggtatgtagaccagctgtatccattgcattttcgttgggttggataaggcgaatatcaaagtttgtaataatgtctccttttggtccgacttcttcagaaattaagcggatgtaaggtgcttttacaatagtgtggtctagctcgaagctttcgacagtgacttcttttttcatggtttcctccaaataagtgatgaatttattataccatatttgacaatttggaattgtgaaatcgtttcaaatatgataaaatagatacagattttgtgaaaatcgaattataaaaaaagaggtagaaatatgaatatcattacagtagtagtgacacttgtttctgctctcattggtttagtattaggttactttgccatttctttgaagatgaaatctgcaaaagaaactgcagaattgacacttttaaacgcagaacaagaagctagtaatgttcgtggtcgagcagaagagcaagctgaggttattctaaaaacagctgagcgcgatcgccagaccttgaaaaaagaattactcttggaagctaaggaagaagctcgtaagtaccgagaagaaattgcagaagaatttaagtcagaacgtcaagagttgaagcaaatcgaatcacgcttgacagagcgtgcgaccagtttggaccgcaaagacgataatttgaccaacaaggaaaagactttggaacaaaaggaacaaagtctgaccgataaagctaagcacattgatgagcgtgaacaagaagttgtaaaactcgaagaacaaaaagctttggagttagaacgagtggcggccctcagtcaagaagaggcgaaggaaatcatccttaccgatacacgtgataaactgacgcatgaaattgcgactcgtatcaaggaagcagagcgtgaagtaaaagaacgttctgacaaaatggcaaaggacttgttagcccaagcgatgcaacgcatatcaggtgaatatgtggctgagcagacgattacatcggttcatttaccggatgatgcgatgaagggacggattattggacgtgagggtcgaaatattcgtacctttgaaagtctcacaggtatcgatgttatcattgatgatacaccagaagtggttgttctatcaggttttgatccgattcgccgtgagattgcccgtatgaccatggagaccttgcttcaagatggtcgtattcatccagctcgtattgaggagttggttgagaaacatcgtgtagagatggataaccgtattcgtgagtacggggaagctgctgcttatgaagttggggcaccaaaccttcatccagacttgattaaaatcatggggcgtttgcatttccgtacctcttatggacaaaatgttcttcgccactcaatcgaagttgctaaattagcaggtgtacttgctgctgaattgggcgagaatgtgaatttggcacgtcgagctggtttcctacatgacgttggtaaagctattgaccgtgaggtggatggaagccacgttgaaatcggtacagaattagctaagaaatataaagagaatccaattgttatcaatgcgattgctagtcaccatggcgatgtagaagcaacaagtactattgcagtcattgtggctgcggcagatgctctgagcgctgctcgtccaggttcacgtcgtgaatctatggaagcctacatcaaacgtctgcaagacttggaagaaatcgccaacagttttgaagggattaaacaatcctatgctattcaggctggtcgtgaaattcggattatcgttcatcctaacaaggtcactgatgatcagattaccatcttggcccatgatgttcgtgagaaaattgaaaataatctggattatccaggaaatatcaaaatcacagttatccgtgaaacaagagcaacagatgttgctaagtaaatgtagaagagtccgaagggctctttttctactggctcaaagttcgttttgggttgggaatagaaaatagaaaatattttaatcgtatttaaaagcagttgaaattcatgctaaattttgttacactagaatgaaagatttaaaaggagatatcatgaaagagcgaggcttactcattgtcttttctggtccatctggtgttggaaaaggaacagttcgaaaggaaatttttgaaagctctgataataaatttgaatattctgtatccatgacgacacgtccacagagaccgggagaagttgatggagttgactatttcttccgtagtcgtgaggaatttgaagatttgattcgccagggtcaaatgttggaatatgcagagtacgttggaaattactatggaacacctctgacctatgtcaatgaaactcttgataagggaattgatgtctttttagaaattgaagtacagggtgccctccaagtgaagaaaaaggttccagatggggtgttcattttcttgacaccacctgacttggaggagttgcaagatcgcttgattggtcgcggaacggatagtgaggaagttattgctcaacgtatcgaacgtgccaaggaagagattgccttgatgcgtgagtatgattatgcagttgtgaacgatgaagttccgttggctgctgagcgtgtcaagcgtataatcgaagcagaacatttccgtgtagaccgagtgattggtcgctacgatgaaatgattcgtgaacagatagtagaacgataaaagaaagaagagagaatcgcattatgatgttgaagccgtcaattgataccttgttggataaggtaccatctaagtattctttggttattcttgaggctaagcgtgcccatgaattggaagcaggtgccaaaccaactcaagaattcacctcagtgaaatccaccctacgcgccttggaagaaattgaatcaggtaatgtagtcatccatccagacccagaagcgaaacgtgaggctgttcgtcgccgtgccgaagaggctaaacgtttggcggaagaagaagagcgtaaaatcaaagctcaaattgctaaagaaaaagaagaaggcgaaaagatttagatacaagactcggttgggattgccatccgggtttcttttcactttcggaatgatgaaagttttgacagaaaggaggcaggtcatttagtttatcttttaatatttgctccaactaatagttgaaggttatacataaagtgaaccttgttcgcatcagtcgtgatattagaaggtaaaataaatcgagatggtatgttagcacagattattgtagacgtccctttgatgcagacagatcaagcttattcctatcgagttccagctgagttggaagaggggctcaaggttggcgtgcgtgtccatgtaccctttggtaagggaaatcggctgattcaagggattgtagttgatttgattgatgaagatgatgaaaatagcttacaagacttgaaagagcttgccgaggttttggactatagtcctgttctcaatcaagagcaattttggttggcggaccagatgagaaagtcggtcttctcctataaaattactctcttaaaatccatgctacccagcttgctcaattcgacctatgacaaattgatccgtccagggattggtttggaaatggcagagcagattagtctgtttggtgataaggagcagattcgtttttctgacttggacgtgacagagcaagggaaaatcatgcgtctggcccagtcaggaaaaatcttggtagactatgtggccaaggataagaagcaaatcaagacagaaaaatggtaccgagtttgtctggagaaattacgagaagcagacatcagcaatcgggctaaaaaacggcagcagttaagggaatttcttctggaacagtcggaagaccagctcctttcaaacctaaaatcggactattcagctgatacgctccgctatttccaagaaaaaggctatatagaagtctgggaagaggaagtgtcgcggactcagggtgtttttgataaggtagaaaaaacgcaggccttggatttgaatccagagcaggccattgcggttcgggagattgtagcctctatcggtcaggaaagtcagacatttctactgcaaggagtgacaggttctgggaagacggaagtctatctccaggttattgatagggtcttgaagatggggaaaacggctattatgctggtgcctgaaatttccttgacccctcagatgaccaatcgttttatttctcgttttggtcagcaggtcgcgattcttcactccggtctgtctgatggagagaagtatgatgagtggcggaagattgaggcggggaatgcccaggtggttgtcggggcccgttcggccatttttgcccctttgacaaacttgggtgttatcatcattgatgaggagcatgaagcgacctacaagcaggacagcaatccacgctaccatgcgcgtgatgtggcaaagttgcgggcagactataatcgagcgaccctggtcttggggtctgctacgccgagtcttgaaacacgggctcgggctagtcgaggagtctatggaagactgactcttaaccagagggccaatcccttggctcgtattccagaagtggaagttgtggatttccgtgattatatcggtcagcaggaggctagtaattttacccctgttctgattgaaaagataagagaaaaattggctcgtaaggaacaggtcgttcttatgttgaataggcgtggttattcttcttttgtcatgtgtcgtgattgtgggagtgttgaccagtgtcccaattgtgatatttccctaacgcttcacatggatacaaaaacgatgaattgccattattgtggttttcaaaaggggattcctcagacctgtccaaactgtcaaagtcgttctattcgttattatgggacgggtacgcaaaaggcctacgatgaattgcaggagctcttgccagaagctagaattttgcgtatggatgtggatactaccaagaaaaaaggtgctcatgaggacttgctcgaacggtttggtcgaggcgaagcggatattcttctgggaactcagatgattgccaagggcttggattttccaaatgtgaccctagttggggtgctcaatgcggatacggctctgaatttgcctgattttcggtcttctgagcggaccttccagttgctaactcaggtagctggtcgggctggtcgagctgataaggaaggagaggtcctgatccagacctataaccccaatcattatgccattgcttttgccaaagagcaggactatgaaggtttctatcgttatgagatggacattcggaaaaatcttggctatccaccttactattttacggtgggtctaaccttttcgcacaagtcagaagaatttgtcgtgaaaaaagcctatgaaactgtagcctttctccgtcaacacttaacagatgcaattcaaatcttgggaccgacgcccaagcctattgccagaactcataatctctaccactaccagatcatcttgaaataccggcatgaagaccgtttggaagaggtattgaatcagattttggattggacacaggagagagaaaatcaagatttgcgactgattattgacaatgaaccgcagaatatgatgtgaggtcactattgaccttgcatttttttgttttaagaacctttgattaaggaaaaaataagcaaaaatgatataattaggggatagtataattgatatgaatcagaaaatgaaaaggagatgagaacacgaatatgacaaagttgatttttatgggaacgccagcgttttcagcgacggtcttaagagggctcttagctgatgggaattataacatactggcagttgtaacccagccagaccgagctgttggacgaaaaaaagtcatccaaatgacacctgtgaaagaagtagccttggaatacaatttaccagtctatcaaccagagaagctatctggaagtcaagaaatggatgagctgatgaatttaggagcagatgggattgtgacggcagcttttgggcaattcctaccaaccaaattattgaactcagttgactttgcggtcaatgttcatgcttctcttcttcctaaataccgtggcggtgcccctatccattacgctttgattaacggtgatgaacgtgccggtgtaaccatcatggaaatggtcaaggaaatggatgccggtgacatgatttccagcgatagcattgctattgaagaaagcgacaatgtcggcaccttgtttgaaaagttggctgttgttggtcgagatttattattacaaaccttaccagcctatattgctggtgacttgaaaccagtcgctcaaaatccagaacaggtaaccttctcaccaaatatccagccagaagaagaggtactggattggaataagacagctcgtcaactatttaatcagattcgcggtatgtacccgtggcccgttgcccacacctattggcaaggcgaacggtttaaaattcaagaagctgtagaagcagaaggtgaaggatcagttggtcgggttattgctcgaagcaagaaagaattgatcattgcgacaggtcagggagccctttctctgaaaactgtccagccagctggtaagccaaaaatgaccattgcagactttttaaatggtgcaggtcgagatattgcagtaggagatcaatttggtgatcaataaacatgaaacagcaagaagtctagccttatctgtattggaacaagtctttgatcaaggtgcttactcgaacatcgctctcaataaggctctagaatcttctcgtttatcagcacaggacaagggcttggcgaccgaattggtttatgggacggtttctcgtaaaattaccctagagtggtatttggcacattttatcgaagatagggaaaagttggacacttgggtctactatctcctcatgttgagcctctaccagttggtatatttggacaaattgcctacccacgcagttgtcaatgaggcagttaatattgccaagcgaaagcctggaactgacaaatttgttaatgccattttgcgtaagcttagtcaggattccttgccgaaaccagcagatattaaaagaaagaacaaacgtctatccgttcagtattctgtgccagtttggttggtccaaaccctgattgcagaatatggcgatgaacgtgcagagaagattttccaaagtttacatgatcggaataaggccagtgtacgtgtgacagatggtcaacaagtggagcgattggcagaggagctaggcgctcaacactcgcagttatcaccagttgggttggttaagcctcatggacactttgcggggacagattatttcaaggaaggactcatcactattcaagatgaaaccagtcaattggtagctccgactttggatattcaaggagatgaaatcatcttggatgcctgtgcggctccgggtggaaagacctgtcatatggcaagctatcttacggatggaaaagtttatgcgttggatttatatgatcataaactaaacctgattgaagaaaacgcacgtcgtttaggcctagcagataagattgagaccaaaggtctggacgccagtcgtgttcatgaggaatttggtccagatacctttgataaaatcctagtggatgccccttgttcaggtattggactcatccgccgtaagccagatattcgttataataaggcatcgatggattttgattctctaaagactatccagttgcagatactggacagtgtttgccaaagcttgaaaattggtggtataataacctatagcacatgtacgattattgctaaggaaaaccaagaggttattcaagaatttctgcaaaaccatcccaattttgaacaggtgacactagaacaccctcaaacagatattatggtggatggttgcttgttgataacccctgaacagtataagacagatggctttttcatcggtcaacttagacgaaaatcctagaataagaggaggaagttgcttagcaacgataaaaattatggaaattgcattacttactgatgtaggacagaaacgttcgaacaaccaagactatatcaatcgctacaaaaaccgcgcagggattgatttggtcgtgttagctgatggaatgggtggtcaccgtgccggccatattgctagtgagatggcagcaacagatttgggagctgcttgggttgatactcaattagtgactttgaatgatgtccgtgaatggatggttgcaatcattgatgctgaaaaccaaaagattcatgaacttggacagacagaagaatacaaggggatgggaacaactcttgaggcagttgttgtcatcgacaatcaaatgatctatgcccatgttggagattcacgagttggattgattagagatggcgaatatacacgtctaactaacgaccattcgctggtaggtgcccttgttcgagctggtcagctcacagaagaagaagcacagcgtcatcctcaaaaaaatattgtaacgcagtccattggacaagccgaaccaattgaaccagacattgctttgaaaactcttgaggttggagattatgtccttattaacagcgatggcttaaccaatatgataccaaccgaggacattcgtgatattgtattgagtgatgtttcaattgaaagcaaggtagaaacacttgtacgttttgccaataatgcaggcggtctagataatattacagtaggtttgcttcacattacggaggaggctaggtaatgattcaaatcggtaagatctttgccggtcggtatcgaatcgttcggcaaattggtcgaggcggtatggcagatgtttacctagcaagagatttgattttagatggagaagaggttgctgttaaagttcttcggaccaactatcagacagatcaaattgctatccagcgttttcaacgtgaagcgcgtgccatggcagaacttgaccatcccaatatcgttcgtatttcggacatcggtgaagaagatggtcaacagtatctggctatggaatatgtcaatggcctcgatttaaaacgttatataaaagaaaatgcaccactttccaacgatgttgcggtgcgaattatgggacagattctccttgctatgcgcatggcgcacacgagaggaattgtccatcgagatttgaaacctcagaacgtccttttgacttccaatggagtcgctaaagtaacagactttggtattgcagttgcctttgctgaaacgagtttgacacaaaccaactccatgttgggttctgttcactatctttcacctgagcaggcgcgtggttcgaaagcgaccattcaaagtgatatttatgcgatgggaatcatcctttttgaaatgttgacgggtcgcattccctatgatggagacagtgctgtgacgatcgctcttcagcatttccaaaaacctctcccatctgttagagaagagaatgccaacgtacctcaggccttagaaaatgttgtactaaaagcaacggcaaaaaaattaaacgagcgctataagtcggttgcagaaatgtatgcagatttagcttcggctctatccatggatcgtcagaatgaacccagggttgaactagaagggaacaaggttgatacaaaaaccttgccgaaactctcccaagccaatgttgaaacgaaagtaccgcatacaaacagttctgctcaagtttctgcgacggataaggggtctggtaagaaagaagtggcgaagtcgggaaataagcctgtttcaaaaccaaggccaggcatacgtacacgctacaaagtcttgataggagctattttgttaacagtcatagcggctggactcatgtttttcaacactccacgaacagttacagtccctgatgtatctggtcaaaccgttgaaaaagctacagaaatgattgaagtggcaggattggaagttggaaatatcacagaagaagcgacagcgactgtagatgaaggcttggtaatacggacctctccggctgcaaagacgaccagacgtcaagggagtaagattgatattgtagtagcaacggctgcgctggcatctattccagatgtggtggataaggagtctgatactgcgcggcaggaattggaggcccttggtttccaagtgacaataaaagaagaatatagcgaaaaagttgcccaaggactcgttatcaaaacagatccaggagcaaatagttctgctgagaagggtgcaaaaattaccctttacgtttccaaaggagtggcgccacaagttgttccaaacgttgttggaaaaagtcaggagaatgctactcaaattcttcagacagcaggcttcagcattggaaccattactcaggaatatagctcatctgttactgcaggtcaggttatcagcacagatcccgttgccaatacagagttggcaaaaggttctatcatcaatctagttatttcaaaaggaaaagaattgattatgcctgatttaacatctggcaattacacctattcacaggcgcgtagtcaattacaagccttgggtgtcaatgcggaaagtattgaaaaacaagaagatagaagctattattcaacgacaagtgacatcgtcattggacaatatcctgctgctggagcaacaattgatggaacagttaccttgtatgtctctgttgcatcaaccagaaccagtagcgattcttcagcaggaagttccacaagtacaagtacttcaacaggtagcggacaataaagatgaataaggttggggagatacccaatgtcattaagttatctaacctatcacattttgtgatgggttagtttttttatgttacactaaaaataaaaggggaaaagtcatgctagatcaaattaaagctcatttatactcttcgaaaatcaaaattatccgttgtcaacttgccttgatgaactccagttctatcttcgacttcgtttcctaggctacttttgattttcattgagtattacttgatagtatagacaatatttagttttatagccctttagtttctctttgattacttcatcaacttgctttgaactaaaagtaaactaaaactatatatcagtcagtcctatatttcctactttggatggagttcttttacttattttttgttacaatagtatagaaaggatggagaagatgcggaaagttcaattttttctactaatagaaagtatgatttttacgatggcagcctttgatgtggtagccaatgaggccagtcggaccctgctacttttctctgccttattactcgtcatttggtacttcctaggaagaaaagtcaacagtgttttactggtcagctccttatctctattatttttggtctttgttttaaatcccttcttcattattgggattatgctactagtcgtgtacatgctgattaatttcttttcacgttatgaaaagagaaatcaatatacccacattgtttttagtgactattctctacaggttcaaaaagagaaaaatagatggtttggcaaccacgaccactctcaagataggtttggttttgaagatattaacattgtacgcttgtttggcaatgatgtagttgatttggataagactgtattagttggcagagataatattgttgtaattcgtaaaacgtttggacggacaaaaattattgttccaattgatgttgaggttgcactttcagcaactagtatctatggacgagtaagtttcctgggtgaatcatattgggatttgcggaatgaaagtatagcggtcaatagtcccgattatcaagaatcacacaaacgtgtaaaagtcgttaccaacaatatactgggagatgtggaggtggttcgcgtatgagaaaacgtacctacctactcctcgcctggtttgcctgtcttattgtttttgtggtgattgcttccaccctcccacttttaaattattcattgctagatgttacgctctggatttcaacggagcagctcgtgtttactctcattctactagttattgttttgaccctttttctagctgtaatggtacaaactgtcagcctagcctccactcaggttatgcggacgaagttacaagctatcttgaagaataaaagtattcgaacagataccgaaagtgatcagctcttgctccagttgtctgataaggtcagaaacctcacgcgtcaggtgcagctggttgacaatcaagatttagtcaagaaagaagagattgttgagggagaacggaaacggattgccagggatttgcatgatacggttagtcaagagttatttgcaacgagcatgattttgtcaggattatcgtccaatctatccactcttccgcaggaaaccttgcaggaacagctgatgctcgtgaaagacatgattgagtctgcccaaagagacctacgcatcctattattacatctacgcccaagtgaacttgaaagtaaaaccttggttgaaggatttgagttgattttgcgtgaagttagcgacaaaagtaatattatcgttcatttccaacatgaagtagaggagttaccgaaactaattgaagaacatctcttccgcattgcgcaagaaattatcagtaataccttgcgacatgccaaagccaagcatttggatgtttacctcttgcagaaggaaacagaacttcagttgaaaatgacagacgatggtatcggcttccaacaaggtgcagatgatgaattaagttacggtcttcaaaacatacgtgagcgggttgaagacatggctggaacgataaaaattcgcacagctccaaataagggagtggcgatcgatattcgtatcccactattgaaaggaaaagaagatgaatacgattcgagtgatgctggttgacgaccatgagatggttcgcctaggattgaaaagttacttaaatttacagccagatgttgaagtagttgcagaagctagtgatggcgaggaaggtttggctaaagcgttagaggttaaacctgatgttgtagtgatggacttggttatgcccaagatgactggcgtagaagcaactctggccttgctgaaggaatggccgcaagcgcagattgtcatcctgacctcctatctagataatgagaaaatctatcctgtgctggaagcaggagctcgtggctatatgttgaaaacgtcaagtgctgacgaaatcttagcagccatccgcaaggtagctcttggagaatatgctattgagacagaagtagagaaaaaagtagagcaccataaacgccacccagatttacatgatgacttgacagctcgtgaacgcgaaatcttgacgctgttagccaagggatatgataatcaacgaattgcagatgagtccttcatatccttaaaaactgttaagacccatgtttccaatatcttatccaaactagctgttagcgatcgtactcaagcagttgtttatgctttccagcatggtttggtggcgcaagaggaccaatagtggtataatgaaaattagttaatttttaaccaaaggatagtggaattatatggatgcaaaactcagatataaggcaaaaaaaataaaaatagtcttttttgacattgacgacacgctacgtgtgaagaatacaggctacattcctgaatcaattcagcaggtttttaaatcactgaaagaaaagggaattttgacaggaattgcgtcaggacgaacgccttatggtttggtgccagaaatcaaggccttaaagccagactttttcgctatgattaacggctcctacgtagaagatgccaaaggtcaggtagtgtaccatcagccgatgccccaaaatttagtagaatctgtattaaattgggctaaagaaattggaatcgaatatggtatgcttagtagtcaaaaagggacactttctgcacgaactgaccgtattagtcaagtaattgacttgatttatgaaggtttggaaacaaaaccaactttttataaagaaaatgatatctatcaattgttaactttcgagaaagatggtcacgaagtagaacttccagaagagttgcaagcagaattgcgtagtgttcgttgggatgctatttcatcggacattgtgttaaaaggctcttccaaagcaactggtgttgctaaggttgttgaaaaactaggcctgaaacctgaaaatgtcctagtgttcggagatggactcaacgatattgagttattcgattatgcaggaattagtatcgctatggggcattcgcatccagaattgcaaaagcatgcagattatatcacaaaaaaagtagaagaagatggcatttttgatgccttggagaaattaggtatggtagaaaaagaaaaatatttcccgcaattagatttggaaaatgttacaggaccagttgcgcatatcaagactaaccatggtaagttaacagtaaaactcttccctgaaattgcacccaaaactgtagcaaatttcgtagctctttctaaagatggctattatgacggaattatcttccatcgtattatcaaagactttatgattcaaggtggcgatccaaccggaacaggtatgggtggtgaatctatttatggtactgcgtttgaagatgaattttcaatggaagcttttaatctcagaggagccttgtcaatggccaatgcaggaccaaatacaaatggaagccaattctttatcgttcaaaaccaaaacttcccatacaatgcgaaagaattagaacgaggcggttggcctaaagaagttgcagaagcctatgtcaaaaatggcgggacaccatatctggatcaacgccacacagtgtttggtcatctagttgatgaagaatccttcgtcgtcttggatgctatcgcagcggttgcaacagattcagcagattgtccacatgaagatgttgtaattgagaccatcgaaatagaggattaagatgaaaatcggagataaactcaaggggacggtaacgggtattcaaccgtatggagcctttgtacaattagagaatgggacgacgggcctaatccatatctcggaaatcaaaacaggttttgttgataatatttatgatcatttaaaattggggcaagaggttttggtacaggtagttgattttgatgaatatactgaaaaggctagtttatcaatccggaccttagaagaagaacaacaaaaaattccgtgccatcatcgttttacaaatgaacggaataaaattggtttttcccccttagcaaaacaacttccgaaatggattgaggaagctaaaggctatctcaaagaacacaaagaaaagaaggtataggatgcattcctaaccttctttctttttaatcattgaactcataaagagctgttgacaagtaacgttctccgttatcaggcaagattgccaacacttttttcccagttcccaactccttagcgacttcgatagcagcgtgaattgctgcacctgaagaaataccaactaagaatccttcttttccaccgatagcacgacctgtagctaaggcatcatcggatttgacacgaataatgccatcataggcgctagtgtccaaagtatctggaataaaacctgccgaaataccttggatcttgtgcggaccaggtgcttcaccagataagacagctgattcatcagcttcaacagcatagatagcaatatctggatttgctgtcttcaaaacatgcgaaacacctgaaacggtaccaccagtaccaacgccagatacaaaggcatctaaaccagttgtgccaaagtcttccaaaatttcctgtcctgttgtatcttcgtgaacttttggattggatggattagcaaactggaaaggaacccagccatttttttcttcagcaatctcttttgctttggcgatagcccccttcatcccttcgctaccaggagtcaagacaagttcagctccataagcttggataatcttacgacgctcaacactcatggtttcaggcatgacgataatcacattataaccttttgctgctccaacccaagcaagaccgataccagtgttaccacttgttggctcaacaatagtatctccaggtttgattgtaccagccttttcagcatcttcaatcatagccaaggcgatacggtcttttacagaagatcctgggttaaaggcctctaatttcacatagacctccgctgccccctctggaacgatattattgagtttaataacaggtgtttttccaactaattgagtaatgttttgataaatagccatatggcacctccaaataatgttattatacattatatagtagaaagtcaaaaaaggataatataaaaaaactatctcgccgatagctttttttaatagacaggtacctcaacgattcgagagttagctttttccgtggatacttttccgtggtaaaagtcagtgagacttgctaaggtttgttcaaggaattctttatctacaaaaatcatggttgaaacttcagtagtaaactgggtatcaaattcttccagaccttgctccgctcgccaattggcaaactcttggtattgggcataggacatgctaagggaaatcccttcctgctccttaacttccacaaccccgatttccttgactgcattagccacggctccagcgtaagcacgaataagtccgcctgccccgagtttgatacctccaaaatagcgggtaaccaccgttgcgacattggtcagttcgtgattttctaaaaccgtcagcattggcacaccagcagtaccagacggctccccatcatctgaggaacgcttgatttccatattttctccaaggacaaaagcagagcagttatgagtagccttgtaatgctctttcttgattttgttgataaagtcgcgagcttcctcctcgctggtcactcgtttcataaagcagataaatcgtgactttttaatttcttcttcaacaataccatcttctctaattgttttaaattctttcataaccaaattgtactaatttttttaaaaactgacaagaaattccgaataaataagtgatgaaagaattagaaaattattatggaagattatttaccaaataccaattgacagcaaaagaaagagaaatagcagaaaaagtgccaagtattacaaaaaagaataactgctttcgctgtggaacaacttttgaagaagaaaacaaattgccaaacgatgcttattactgtcgagcctgcttgcttctaggcagagtacggtcagacgaaaaactctatcattttcctcagaaagattttccaatcactaagtgtttaaagtggaaaggtcaattaactgattggcaacaaagaatttcagatggactagttgcaaacgtggaaaataatcgtgcgacattggttcatgcagtaacaggagcaggtaagacagaaatgatctaccacaccgttgcctcagtgattgataaaggcggagcggtttgcctagccagtcctcgaattgatgtttgtatcgaactctataaacgtctgcaaaatgacttttcagttccaattagtttactacatggagagtctgaaccctatttccgaaccccattagttgtagcaaccacacatcagttattaaaattttatcaggcctttgatttggttttgattgatgaagtagacgcctttccctatgcagataatcccatgctctatcgagcagcagacaatgcggtcaaggaagctggtgttcaagtttttctgacagcgacttcaacagatgaattggataaaaaagtcagaacaggtaaattaagtcgtcttagtttgccaaggcgctttcatggcaacccacttgttgtcccgcaaaaagtctggtttagtaaattcgatgataccctaaagaaaaatagactagttccaaagttgaaaaaagcgattgaagaacagagaaagtcgtgctttcccttactcatttttgtcccagaaatctccaaaggtcaagaatttaccaagataatgaaaaaaacattcccagaagaaacaattggctttgtatccagtcaaacagaaaatcgccttgaaatagttgaagggtttcgcaagagagaaatcacagtcttaatctcgactactattcttgaacgtggggtgaccttcccatgtgtagacgtctttgttgttcaagccaatcattacctctacacagtgtcaagtcttgttcagattgcaggccgagtcggaaggagtatggaacgtccgactggtttactccagttttatcatgagggaagtacaggagccattgaaaaggcagtcgctgaaattaaacagatgaacaaggaggctggttatgtctaattgcctattgtgcggtcaagctatgaaaaataaaacaagattttcagatctcatcttctttagtaaagaaaaatcgggcatctgtgaagaatgtttttcgacttttgaggaaatagcagagcaacactgtccacattgttataaaaatggggaatcggaaagttgcaaggattgtcagtactggcagaatcaagggaaaccagttgtccacacagctttgtaccaatataatcaagcgatggcgcattattttagtcgctacaaatttcaaggagactatgttttaagaaatatttttgctaaaaagcttagaatagcgttaagccaatttcctgactacacaattgttcccataccaattagtcaaaaacgactatcagaacgcggttttaatcaagtggaaggacttttggatgctacaaatattccctatcagtcccttcttggaaagtatgaaagccaaaaacaatcatctaaaaatcgtgcagagagactagaagcaaaacagatgttctatctattagatgaaaaagaagtgccagaaaaaatattattattcgacgatatatatacaacaggagccacaatccaacttgctgtagaacttttcatgaaaattggtaggaaagaaatcaaaacattttcactaacacgataagaaaacggttgcaatatccctataatgtggtataataatagtgaagaaaggcgaaagccaagaaagaggtactaatatgattaaattcagtattcgtggagaaaaccttgaagttacagaagcacttcgcacctatgtagaagagaaagtggctaagattgagaaatatttcaatgaagaacaagagttgaatgctaaagtaaatctaaaagtttaccgtgacaagcgtgcaaaagtagaagtgacaattccagttggagcagttacacttcgcgcagaagatatttcacaagaaatgtatggctctatcgatcttgtagtagataagattgaacgccaaattcgtcgtaacaaaaccaagattgaacgaaagcatcgtcaaaaagtggcaactggtcaagtctttacagatgaacttgttgagcaaacaggcgaggaagtaaaagtggttcgtactaagcaagtagacttgaaaccaatggatatggaagaagcagtcctccaattggagttgctcggacatgatttctttatctatacagatgctaatgacggtacaacaaatgtattgtatagacgcgaagatggagatttgggtcttctagaggtacgtcaataaagataataaaacagttgcagtttttgcagctgttttatcattttcaaaaaaccggttgacaatgtatataagtcgtgatagaataaatgagttgtctcttgagggactagttaacagagaaacgaaaaaagtttcaaaaaagtgttgacaaagttcacaagaaatgataaactaagatagttgtcgcgagagcgcgataacgacaagacctttgaaaattaaagaagacgaaccaaacgtgcagggtgatttatctaaagataaatcgtcaatgacaaaacaaaacaataaaacggaaagctagcaatagcttgagtttgaatcaaaactttttatgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaaatggaaacctgtacgtcagtcttctttaattttgagaggtcttgtggggccttagctcagctgggagagcgcctgctttgcacgcaggaggtcagcggttcgatcccgctaggctccattaacaacggaagttgttaagattttgtccattgaaaattgaatatctatcaaacattcctaaacgtatgtaaaagtacgtatagaaatagtaacaagaaaataaaccgaaaacgctgtgaatatttaatgagttttctaatttttgaaaaaattaggttaaaacaagttacgaagacgttaaggaaaacgtatgattttaggaaatcatcgcagtagtctaaggactacaagaggatttgtctaaatcactagttttctagtctgagtacgattataaggttaagttaataagggcgcacggtggatgccttggcactagaagccgatgaaggacgtgactaacgacgaaatgccttggggagctgtaagtaagcaatgatccagggatgtccgaatgggggaacccggcaggtaatgcctgtcactcactactgttaaggtagtgaagaggaagacgcagtgaactgaaacatctaagtagctgcaggaagagaaagcaaaagcgattgccttagtagcggcgagcgaaacggcaggagggcaaaccgaggagtttactcctcggggttgtaggactgcaatgtggacttaaagagtatagaagaactacctgggaaggtaggccaaagagagtaatagcctcgtatttaaaatattttttatacctagcagtatcctgagtacggcgagacacgcgaaatctcgtcggaatccgggaggaccatctcccaaccctaaatactctctagtgaccgatagtgaaccagtaccgtgagggaaaggtgaaaagtaccccggaaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcggattagtattatgtcgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacatttgagaatcttggaggtagagcactgtttggatgagggggccatctcggtttactgatttcagataaactccgaatgccaatgatttatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggataacactttagtgttatggtaggagagcgttctatgtgtgaagaaggtataccgtgaggagtgctggaacgcatagaagtgagaatgccggtatgagtagcgaaagatgggtgagaatcccatccaccgtaagactaaggtttccaggggaaggctcgtccgccctgggttagtcgggacctaaggagagaccgaagggtgtatccgatggacaacaggttgatattcctgtactagagtatgaagtgatggagggacgcagtaggctaactaaagcgggcgattggaagtgcccgtctaagcagtgaggtgtgatatgagtcaaatgcttgtatctgtaacattgagctgtgatggggagcgaagttaagtagcgaagttagtgacgtcacactgccgagaaaagcttctagcgatgtatcatactctacccgtaccgcaaaccgacacaggtagtcgaggcgagtagcctcaggtgagcgagagaactctcgttaaggaactcggcaaaatgaccccgtaacttcgggagaaggggtgctggcttaaagtcagccgcagtgaataggcccaagcaactgtttatcaaaaacacagctctctgctaaatcgtaagatgatgtatagggggtgacgcctgcccggtgctggaaggttaagaggagggtttagcgcaagcgaagatctgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctacgaagtcgggacgccagtttcgactgaggcgctgttgggatactacccttgtgttatggctactctaacccggataggttatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggacgggataaacgctgaaagcatctaagtgtgaaacccacctcaagatgagatttcccataactttatgttagtaagagccctgagagatgatcaggtagataggttggaagtggaagtgtggcgacacatgtagcggaccaatactaatcgctcgaggacttatccaaagaaataaactagagtcaatattgacaagcgatcggtttcttgttagaatatagatattcaattttgagttgacaagactcagtagttaagtgacgatagcctaggagatacacctgtacccatgccgaacacagcagttaagccctagaacgcctgaagtagttgggggttgccccctgttagatacggtagtcgcttagcaaattgggagtttagctcagctgggagagcatctgccttacaagcagagggtcagcggttcgatcccgttaactcccataggtcccgtagtgtagcggttatcacgtcgccctgtcacggcgaagatcgcgggttcgattcccgtcgggaccgttgaaacgaatcaatcatatgtttcaagtaatataattaagtaaagactcgttagctcagttggtagagcaattgacttttaatcaatgggtcgctggttcgagcccagcacgagtcatatgcgggtttggcggaattggcagacgcaccagatttaggatctggcgctttcgggcgtgggggttcaagtcccttaacccgcatagaatggaaataggccggcttagctcagttggtagagcatctgatttgtaatcagagggtcgcgtgttcaagtcatgtagccggcattaggaaagattgcgaacgtagttcagtggtagaacaccaccttgccaaggtgggggtcgcgggttcgaatcccgtcgttcgctttgagaggccggggtggcggaactggcagacgcacaggacttaaaatcctgcgatggcaacatcgtaccggttcgattccggtcctcggcatgaagattataatagttagcacccttagctcaactggatagagtacctgactacgaatcaggcggttagaggttcgaatcctctagggtgcatcactcgcttaatggagacgttaggggagctttatttttaatagtatcgggaagtagctcagcttggtagagtacttggtttgggaccaaggtgtcgcaggttcgaatcctgtcttcccgattattgtaagagagcagcaatgttcttttttttttggctctttgtcaactgtagtgggtagatgaaaagctaacacctagagaggacgaaattcgttctctctttcttgtttttaggagatgagctgaaaagagctctcctcagcttttcactgttcaaagcatcaaaatccgtttttctagtttccattttcctgaatccaaaggcatttcttttaatgactttgatgagattgttagttgtttctgatttggtgttggaaattgtgagttttgttgtttttcatactcaataaaaatcaaaaatagcaagtctaatttacttataacatgtaaaaccttaatttataagtttgagttgaggattgtggatttcaagtagctgtttttttctcaaaaaataacaaaatcaaaatgctccatatctactttgagtggtaggtggctatttttgattttaaatgggtatcagtgtaggtcgtaggggacttttttctacactcaaaaaggctctatatgaccatagtgggtttacccgtcatagtcttatagtgccttttattttttgcttagtttaacaaccgcctcggtccgtgctgtgtggggaaacatgtcaacagattgaatgtattctaccttgtaggctttgcttagctcaacaaggtcccttgcaagagtggagacgttgcaggatacataaaccattttagctggtttgtaattcaaaatggttttgaggagcttttcgtcgagtccagttcgtggaggatcaactaccaaggcatcggccctgtagccttcttggtaccactttggaatgatttcttctgctttacctgcctcatagtgggtattggatagtcccattcgcttagcgtttgctttagcatcctcgatggcttctggaataatgtccatacctcgaacagatttgacctttttagcaaaggcgaagccgattgtacccacgccacagtaggcatcaatcaagtcttcatctcctgaaatatccaaagccttgacggcctcgccatagagaatttctgtttgttggggatttaattggtaaaatgcccgtggagatagtgagaattcgtaatctaaaacagcttcatcgatagcttgttctccccataaaatttctgttttttcaccataaatatcactcgttttctgtctattccagtttagagcaatagtgattatacttggaaattgactggtgagttcatcaattaatttaataagattaacctgacaagaggtgataaatatcacttgaacttgacctgtttttcgagccttgcggaccatgaccgtgcggattccatgttgcttgcgctcattataaataggaatacggtgcttggtgagtagctttgcgattccgttgataatctcttgtgtttcggcatcttggacgtaacaattcgtaattccaatcaagcgatgggaattttccgcatagagaccggccttgacttgatctttgaaagatcgagtctggaactgtaatttggcacgatagtggctaggcttatccataccgattgttggataaatagtatagttttcgtagccagctggtttgaacttttttagggcctgctgcaagagatcttgtttgaagtctaattgtttatcatagcggaggtgcatgatttgacaaccaccacaggctcgatagatgtcacaggccggcttgacacggaattttgattccttgttgatttttaacaattttgcttcaacgaaatttcgtttgactgaggtaatttgacaaaaaatttcttctcccttaaggacaccagggacaaagactagcgttttttgataaaatccgatgccttctccgttgatgcccattcgtttgatttttaaggggattcgttggtttacttgtagattcatattattattttaccgaaaaatcctgtataatgaaagaatgagaattacaaaaattgaaaagaagaaacgtctttatttacttgaagtggatggtcaggatagtttatatattacggaagacacaattgttcgcttcatgcttagtaagggaaaggaaatcacggagcaggagtttcgtgagcttcgcgattttgctcagttttcttatgggaaaaatctagcactttattacctttccttcaagcaacgtaccaaaaaagaagttagtaattatctaaaaaaatatgaaattgaagaaaacaatattgtcaagattgtgacggtattagaagaggaaaaatggctggacgatgggaattatgttgatagctatgttcgtcagaatgctctaaatggagataagggaccagctatgattcgtcagaagttgatgcagaaaggaattcctaaaacgctgattgataaaagactggctgaggaagatttttcagagcttgctgggaagattggggagaaattggtgggtagataccaaagaaaattgcctcttcgagctttgcaagataaagttgtacagggattgatgggtaagggtttttcttatgaggcggccaaacaaagcctgggtcagttggaacttgtggctgatgaggaaaatgaagatgatttaatcgccaaggaattggataagcagtatagaaaatatagtcgtaaatatgaaggctatgaattgaagcaaaggttgatacaggctttggctcgaaagggttatgactttgatcggattcaggctgtccttcgtgattatctgtgaaaaaatttagcctaggttagaaaaatatgatataatagtcaagataaattgtaattgtagaaagttggtaacaaagtgaaattaccaaaggaaggcgactttattacaattcaaagttataagcatgacggtgaaattcatcgcacttggcgtgacaccatggtattaaaaacaacggaaaatgctattattggagtcaataatcataccttagtgactgaaaatgatggtaggcgttgggtaacaagagagccagcaatcgtttattttcataaaaaatactggttcaatatcattgcaatgattcgtgaaaacggagtttcctattattgtaaccttgctagtccatatgttctcgacaatgaggcactcaaatacattgattatgacctagatgttaaggtctttgctgatggtgaaaagagactgctggatgtggatgaatatgagcgtcatcgtaaggcgatgaagtattcggatgatattgattttattttgaaggaaaatgtcaagatactggttgattggattaataaccagcgcggaccattctctccagcctacgttaatatctggtacaaacgctatttagaactgagaagtagataaagttagaaaagaaaatcctgttttacaggcttttttcttattgtaaaggaggggcttatggcctttgaacaaacaaatgggcgctatgcaagttttggagttgtgacttcgcttcctggggaagtgattgatagtttctggtatgttattgatcactacttaaaaggggttattccattaaaaagtgtaatccgtttttctatcaaaaatcgtcgtggtaagattacgctggtcttttcgcaggaaggttataaaaatgtactggctgtagatctaagtagtcgttttgatcctttttatccctcaacaatcttggtaatggacaagcagggaaaagagaccattactttgccagatgaggtaaccttgctttagcttgaagagctggtattttatcacccaagatattgttaatatatgaaatttggtgtaaaatagatttgtaagcttatgtgggttagaaaggaggagtctatggttagtcaaactgttgaaaaacctctctatttgcagttggttgatgaattagaagttgcaattcgtgagaggatggctccgaatgacaagttattttcagagcgtgagttgacacaggtttatggtgtcagtcgtattacagttcgtttggctttgcaagaattggaaaaacggggcttagtctataagaagcatggtaagggaacctatgtatctgagatttcagatactgcagttgatttgtctcaggcctatagttttactgagcaaatgaaaaaaattgggaaagtaccgaggacatctattttatcctttgaattggttaaggcgtcagactatattgcgcagcatttacaacttagtcaaggtgaggaagtgtttgaagttgaacgattgagacttgccgatgagattccgatgatgctggaaaggacatatgttcctgcttcggtatttcctggattagctgctcagcgaatgaagtcaactcccttgtatgaaattttttcagaggattatcatcaggtgattcgtttggcagaagaagagttctatgcaagtattgctttggataatgaagctaagatactcggaattccaagcaatagtccagtgcttcatttggtaagaaaaacgtataatgataagaatagaattatcgagtttacgtttagtattgctagagcggaccagtttcgttacaagattacccatcaacggggatattagaatcaatactcttcgaaaatcaaaattattcgttgtcaagagccttgatgaaatccagttctatcttcggcttcgtttcctaggctacttttgattgttattgggtatgaaaaaaacgcggacgttagtctgcgtttttttagcgatggttggctgtaatttcaaatttgtaatacttccagtgcttgtaagtttcagtatattccatcacttcaccgctagtactgttagtagttgttttgttttgtagtacagctggttcagtcgcttttaatttcaaatgggtggcaacctcttttggacatgggctgacaatttcattcgtttctacaaatggttcctcggacatgtggatattgtagtccagtttgaagcgttgatagattgattgatagtgctcgagtggagcatcgggattctggatatatcgttgagggatgtatgaattgtggaagatgtatggagtgtcttctgctgcgcggacgcgtacaattttatagtaaaactcattcttgtcaagatttagtttttcaaggatatcgggtttattgcctttttcgcacgagagaacagtaaccttatccttatccatcggaaaaatctcaatatcagaaaattctacaagacgtcctttacgtgaacgagatacaaaggttcctttaccttgttggcgaacgaggtaaccatctttaactagttcgtttactgcacggataacggtaatggagctaacattaaatagttttgttaattcagattctgtgtaaaatttgtcgccattttcaaatttgccagaaacaatctgttggcgtaagtcgttttgtataagttggtacttcggtactttcatacttatttccttcctttccacaacttattatactaaattagttgatgaaaatcaaaaaatatagctaaaatacccacaaaaatatactttttcactttataaaggtgataagaaatggtaaaaaaatttttaaaaagtactggacataaccacaaagaagtgttagtatattaatagaaaggtaagcggttgcatcggaggaagaaatgaaagaattttatattggagaccaattttatttggacggtgaaccctttaagattttatcaggcgcgattcattattttcgtgtccatcctgatgattggtaccattctttgtataacttaaaggcccttggttttaatacggttgaaacctatgtcccttggaatatgcatgagcctcgaaagggtgagttttgttacgagggtatattggatattgagcgatttttgaaattggctcaagaattagggctttatgcaattgtacgaccgtccccctatatttgtgctgagtgggaatggggtggcctccctgcttggttgatgaaggaagagcttagagtacgttcgagtgattcggtgtacttgcagcacttagatgaatattacgtttctcttattcctaaattggccaagctccaactcgcacagggtggaaatgtacttatgttccaagtggaaaatgagtatggatcttatggtgaggagaaggcatatttaagagcggtggctggcttgatgcgtaaacatggtctaactgctcccttgtttacctcggacggttcttggcgagcaacattacgtgcaggaacactgatagaggacgatgtatttgtaacaggaaactttggttctaaagctagagagaattttgcaaatatgacggcattctttaatgaacatcagaagaattggccactcatgtgtatggaattttgggatggttggttcaatcgttggggcgatgaaattattcgtagagagccggaggaaatggttgattcagttatggaatgtatcgaattgggctccttgaatctgtacatgttccatggtggaacaaattttggtttcatgaatggttgctctgctcgtggtcaaattgatttgcctcaggtaacttcttatgattatgatgctatattggatgaagctggaaatcctactaagaagttttatattttgcaacaacgtttgaaagaagtctatcctgaattagagtatgcagaaccgcttgtaaaagaggcaaaagctttttcagatgtgtcgcttcatgataaggtgagtctgtttgctactctagaaaatgtaagcgattgcgtaaaagggttttatcctaagaatatggaagaacttgatcagtcaacaggttatattttatatagaacagagttggagcgggataagacagaagcagaacgtttccgagtggttgatgcgcgtgaccgtatccaaatttatgcagatggaaaattcgttgcaactcagtatcagactgagattggtgacgatgttgaattggattttaaagatgacaagctaacattagatattttggtagaaaatatgggacgtgtcaattatgggcacaaactaacggctcctacccagtctaaagggattggtcgaggtgcgatggctgatttacattttattggtcattgggaaacctatcctttgcatcttgagtcagttgaggacctggattttagtaagggctgggaggaaggtcaagctgctttctatcgttatcagtttgaactggatgaacttgcggatacttacttagacatgacaggttttggtaagggagttgttttcgttaataatgtaaatattggacgtttttgggaaaaaggaccaatcctctatctctatattccaaaaggatacttaaagaaaggagcgaatgaaatagttgtcttcgagacagaaggaaaatatagagagaagattcatttttcacaaagacccgttataaaagacttgtagaaattttaatcggtttctgctcaaaagatttatgaagaaaaggagaacactgtatggcaattattgctacgcgtattgatggtcgtttgatccacggtcaggttgctaacttatggacgacgaaattgaacatcggtcgtatcatggttatcgatgatgctgttgctcaaaatgacattgaaaaacaaggactgaaattagcatgtcctccaggcgtaaaattatcgattttaccgatcgaaaaggctgctaataacattaaggaagggaagtacgatagccaacgtcttttgattgttgcccgtcgtcctgaaaacttcctacgtttagttgaatatggagtggaattggcagaattgaacgtagggaatatgtctcaaactccggaaactcgttctgtaactcgttctattaacgttgtagataaggatattgcagattttgatgccttggcggctaagggtgtaaaattatttgcacaaatggtacctggcgattcaccaaaagactttatgccattattggataaggttagataacattcggatatttttgaaaaatttaaaggaggatcactattatgcaatggtggcaaatattacttctaacgctctactctgcttaccagatttgtgacgagctgacaattgtatcgtcagcaggttcaccagtctttgcagggtttatcactggtttaatcatggggaacatggaagttggcttgctaattggtgcaagtttgcagctagttgtcttgggagttggtactttcggtggtgcgtcacgtattgatgcaacatctggtgcggttcttgcgacagctttctcaatttcacaaggtttagatccagaaattgccatttccactattggcgtaccagttgcaggattgttggtttatacagatattttaggtcgtttcaccactactttctttgctcatcgtgtagatgcagcaatcgaacgttttgactatgctggtattgaacgcaactaccttcttggtgcaattccttgggcactttctcgtgcacttccagtttttcttgcccttgcttttggtggtggtcttgtagaaactcttgtcactacgattgagttgcctgaatacaaatggattgcagcaggcttaactcttgcagctcgtatgcttccaggtcttggatttgcaatcttacttcactatcttccacttaaacgtaaccttcactacttggcggtaggtttcgctcttacagctatgttgactgttctttacggtaacgtatcagctttgggtggtgcagttgctggtatcgttggcactcttcctgaagatgcaggcgtaagctttgtcaataacttcaaaggtttgtcaatgattggtatcgctattgtgggtgcatttctttcagtgattcacttcaaaaatagccaaaaagtaactgtggttgctccatcaaattcagaaagtggggaaattgaagatgacgaaatctaattacaaattaacaaaagaagattttaatcaaatcaacaaacgtagcttgttcactttccaacttggttggaactatgagcggatgcaggcatctggctacctctacatgattttgccacaattgcgtaaaatgtatggagatggtacacctgagttgaaggaaatgatgaaattgcatactcagttcttcaatacttcaccattcttccataccatcatcacaggtattgacttggcacttgaagaaagtgatggtgttgcttctaaagatgcggttaacggtgttaagacaggtttgatgggaccatttgctccaatcggtgactcaatctttggttctcttgttccagcgattatggggactgtggctgctactatgggtaaagagggatctccagttggtatctttctttgggtagcagtagccattgcctatgatattttccgttggaaacagttggaagttgcctacaaagaaggtactaagttgattacaaccatgcgcgatcgcttgacagctctcgttgatgcagcatctgtaatgggtgtcttcatgatgggtgccttgattgcaactatgattaactttgaagtgacttgggctccagctattggagaaaaagtgattgatattcaagacattttgaataccatcttcccacgcctagtacctgcaatctttacaggatttgtcttctggcttcttggtcgtcgtggcatgacttcgactaaagctatcttgattattattgtgcttgcacttggcttctcagcaatcggtcacttcctatttggtatggtataatggttagaagtttagtattagtaagtcatggtatcttctgcgaggagttgaaaaaatctactgaaatgattatgggtcctcaagaggacatctacacagtagctttattaccagaagaaggtccagaagacttccagaaaaaatttgaagaaacaattgcaggattggaagattttgttgtcttcgcagacttgttgggcggtacaccagccaacgtcgtatcacgaaaattgattgaaggtgggcagtttgacctttatgcagggatgaatatgccaatggttatcggtttcttgaacggcgtcctgctgggagaggctgtggattatgtagaatttgggacaagcaacctagttcatgtcaatagtctattaacaagtgatgaagatgacgatgagtgaaacagtttgggaaactgtttccactggtcaccttgaaatgaaagagtgaccaaagacagcccgagcctagaaataagagagtgaggctaactcagctgattgttacagacggatttgattttcgttaattataaaatgttctatagttgataggctttaagtatcctgaggaagttgcaatagtgactccctcatttggcttgtgaggaaaagaaatgattgaagtaaaaacatttgatgaaaaagcaaaactgtattgcttggaaaacaagaatgggatgcaggtaaccttgacggattttggtgccagagtggtggaagtgcttttgccagtagaagaaaatggcggtctacggaatgtcagtttagctgccaagtcggatgatgattaccgtaagacagatttgtaccctggttcaactattgtcccagtagcggggcgtatttcaggtgcccaagctgagatagagggaacaagctaccatttcacagaaaatgaacctggtaggactctacacggtggggttgacacggcaaatgagcagtactgggacgttgagctagaccatgagagaaatcaagtgacctttggtatggtcctaaaagatggttttaatggctttcctggtgatgtgagggtcaaggctatttattgtttgacggataaaaatgaattgacagttgactaccaggctgtatcggataaggatacgatttttaatccgaccaaccatatctatttcaacttgactggtgattttcaacggtcagttgccgagcaccgtattaaaattgctgccaatcactatgctccgcttggggaggataacctgccaacgggtgtcttagaagatgtgacagggacgccgtttgattttagagattttgcgccttttgctcagggatttgatagccaatatcctcaaaatgtgttggtaaaaggctatgaccacccatggttattggaagaggtggatattccggtagaagttttgagtccagatgggaaaattggactcagtgtcaaaaccaaccagcctgcggtcgttatttatacatataattttcctgttgaagctttggcctgttaccatggtgtctttagtttagagtgtcaggccttgccaaatgcatgcaatgtcgatggatttggttcgattttgttagaacaaggagaagaatttttgtctaaaacgacctatcgttttacttggtaaaaaaatggggactctaactgtgttacagttagggttttcttgtgttttctagaaaatatggtataataaaccggtgtgtttcaatcgaagcaggcgaaagaggaaaataatgacaaaagaacaagaatttttaaaagaatttgaggcttgggtcaacactcaggtcatggtaaacgagatggcggttgaagaaagtcgtcgtgtcttggaagaagacaaggatgagcgtgcagcggatgcttatattcgttatgagagcaagctggatgcctatcgattcattcaagggaaatttgccaactaccatgctggcaaaggttttcatgatttgccagatgagttgtttggtcaaaggcattattaaggagaggagttaacatggcaaagaaaaaagtaaatcgaaaaaaacaattgaaaaaacaattagcagacttgaaacgtgcaggtcgtgtaggtcttgaaagagctgcagaggtagtagagacagttgctcacaaggctgaggctgtagtagagcgtactgtggaacaagtgaaagaagttgtagcagaggtgacttcttcagcgacttcattggaagactttttggcgcttcctgagttggaaggcattgcggcagcacgtttggaaaccttctacgaagcaggtattcaatctgtggctgattttgcaaaccatacagaaaaagagctcttggctcttaaaggcatcggtcctgcaactatcaagcagttgaaagaaaaagggattgagctgaaagcttaaatcccttgcttttcaaggtacaatttgttacaataaagccattcagaggtgttttgagccccatttgtcacaggaagcggtggtactgagaaatccgcacaaatgtcaaaactggttgctgatgatgtgaatcgaataagcaaagtgcagataatgtatctgaacaagggtggtaccgcggaataacttcgtccctgtctagcaagtctaggcggggattttcatttggaaaggagaagatatgttacatcatgttgaaatttacgtttctgacttggaaacttcgcgtgcattttacgactttctcctgaccaagctgggctactcgctctatcaggagtgggataaagggctgtcttataaaaaagcagagcaatacctggtctttgtccaaacgccagaggacttcctagaggtaggctaccaccgttgccgcacaggtctcaatcatctagcttttcatgcagggacacctgatgagattgaccaatggcggaaggaatttttgaccagacgagtcaaacttctctacgacgaccgctatccccacgcaggaggaccagaccactatgccctttatttggaagatccagatgggataaagatagagttggtgggggagggggtatgaatctaattattattggagcacaagcttctggcaagatgaccgttgggcaggaagttgcgaaattgacagggatgaccctttttcataatcacgattcgattgattttagcctacgttttattcctgaattttctgaggatatgtttgacctcaatacacgtattacatttgctgtttatgatgtgtttgctaggtcaggccgtccactaatcggaactgccttgattaattttaaaaatctcatagaggttcaattccttacaacagttcagacgatttttcatcatcatggccaggaaattttatttgttgagttggaaaccgctttggaagaacgtttgcggcgtaatcggacagaaaatcgacttacccataaacctttgaaacgacacattgaagtttcagaggctgagattctctctacagctgatacatgtcgatatacctcgttaggcattccagagggcattcagcattatctcaaaattaataatactcatctttctgccaatgacgtagctcaactaattatccaaaaaatggaggaacttgagcaagaacaaacgaaatagccagcccaaaggactgactatttctaggagattatatgaaaaagaattgggctatttctagcttgaagatagtataaaccaatttttttaaagaatactgaaggagaaaaaataatgtcaaaagaattatcaccaaaatacaatccagccgaggttgaggctggtcgttaccaaacttggttggaccaagatgtttttaagccgtcaggcgatgcggaggctaagccttattctatcgtgattccacctccaaacgtaactggtaagttacacttgggacacgcttgggatacaacccttcaagatatcatcatccgccaaaaacgcatgcagggatttgataccctctggcttccaggtatggaccacgcggggattgctactcaggctaaggttgaggaacgcttgcgggagcaaggcgtgacccgttatgacttggggcgcgaaaaattcctcgataaagtctgggaatggaaggatgagtatgcagcgactattcgtgaacaatggggcaagttgggtctgtctttggactaccaacgtgaccgcttcacgctggacgaaggcttgtcaaaagccgttcgcaaggtctttgtagaactctacaaaaaaggctggatctaccgtggtgaatttatcatcaactgggacccagcggctcgcacagccctttctgatattgaagttatccacaaggacgtagagggtgctttctaccacatgaattatatgttggaagatggttctcgtgcccttcaagttgccacaactcgtcctgaaaccatgttcggtgacgttgcggttgcagttaacccagaagatccacgttacaaggacttgattggtaaaaatgttatccttccaattgtgaacaagccaatcccaatcgttgcggatgagcacgcggatcctgaatttggtacaggggttgtgaaaatcactcctgcgcacgatccaaatgacttcctcgttggacaacgccacaatctgccacaagtcaatgtcatgaacgacgacggtactatgaacgagttggctggtgaatttgcaggcatggaccgctttgaagctcgtaaggcaacggttgctaagttgcaagaactgggtgcccttgtggaaatcgaaaaccgtgtgcattctgttggacactctgagcgtacaggtgtggtagtcgagccacgcttgtcaactcaatggtttgttaagatggaccaattggccaagaatgccattgccaaccaagatacagctgacaaggtagaattttacccaccacgcttcaacgatactttcctacaatggatggaaaatgtacacgactgggttatctctcgtcagctttggtggggtcatcagattccagcatggtataacgaatctggcgaaatgtacgtcggagaagaggctccagcaggtgacggttgggtacaggatgaggatgtcctagatacctggttcagctctgccctttggccattttcaaccatgggctggcctgacgaaaacgcggcggacttccagcgttacttcccaacctcaaccttggtaacgggctatgatattattccattctgggtgtctcgtatgattttccaaggaattgaatttacaggcaagagcccatttaagaatgctctgattcacggacttatccgtgacgaagaaggtcgcaagatgtccaagtcgctcggaaacgggattgacccgatggatgttatcgagaaatacggtgcggacgctttgcgttggttcttgtcaaacggctctgcccctggtcaagatgttcgcttctcttatgagaagatggacgcatcttggaacttcatcaacaagatttggaacatttcccgctatatcctcatgaacaatgaaggtttgaccttggatgcggcgcgtgagaatgttgccaaagtcgcagctggcgaggctggcaacgtgacggaccgctggattctccacaacctcaacgaaaccattgccaaagtcactgaaaactttgacaagttcgagtttggtgtggctggtcacatcctctacaacttcatctgggaagagttcgccaactggtatgtcgaactgaccaaggaggtcctttacagcgacaacgaggctgagaaagtcatgacccgctctgtccttctctacacgctggaccaaatccttcgcctcctccacccaatcatgccgtttgtgacggaagagattttcgcccagtacgcagagggttctatcgtggtagcggcctaccctgttgtcaacccagcatttgaaaatgcggaagcccacaagggagtggaaagtcttaaagacttgatccgttcggtgcgaaatagcagagcagaagtcaatgttgctccttctaagccgattaccattttgattaagacggcagatagcgagcttgaaaccttcttcaaggcaaatgaaaactacatccgccgctttaccaacccagagcagttggaaatcagctcaagcatcgctgcaccagaactagccatgtcagccgttatcaccggtgctgaaatcttcttgccactagcagaccttcttaacgtcgaagaagagttggctcgtctagacaaagaactcgtcaagtggcaaaaagaactagacatggtcggcaaaaaactcagcaacgaacgcttcattgccaacgctaaaccagaagtcgttgaaaaagaaaaagaaaaacaagccgactaccaagcaaaatatgatgcgacagtagcgcggattgaagagatgaagaagttggttaagtaggtagaatacgataaaatgcccagcctaaaatggctgggttttgtggtataataaaattaatacattaggagttttatatgatgattatattaatttgtctttccttatttattataagtagaacaatgaatggctttcgattatttctagattctacaattattatagggtttatttgtctgtttttctattattgttgttttgacttaatttttattagcttgacaaatttggttttaatactaattttgttagtttattctttctcagacatcctttttggaattagaataataggcctaagtataccatttattagaagtattgttctaaaatatattgactgtaagggatttttacaaaataaaataaggaatcacttagttgaaattagagaaattatattagttacattcctttttctgatttttggggttcaggttcaacttcaactaccctatatcaattttactaattatagtttaatagaaatattaggatttgatatcgcaatttttagtttatatggtatctatgtagcttttttacagtttttaactgaaaatgataaagtttattacttaggtgttagtaagattcgcttcatgctagataattcagtgtggtcgcagctaaccagagctaaattatttcatattattctattagtgtcggtattaataccgttgttcagcaaaagtaatatagaatttaattatcagcttcagaatatagaatatctgtggcaaacctgttacattatttctatcgtggtttatatctttttgctgaaacttagtatcagtattgtatatggggtttttagattaaatttagaaaatgtaagtaagacggttaaaaaggaagatgttaaggaaaaagatagtagacataaagaaaaaatttttaatagatttggtatcactgataaaattaatatctcagtacaaaggtcctttaaggatgagttttggaaaatttataaaaatcaaaatcaatatagggatgattatataaaagtaagacttcaagagagaattacattggttgagaaagctgatagggatgaattaatttttactatttttggcagagaaaattgggaaaattataacttatcagaaagtatatttgtatttatagaaaatatagatagtgatgaaggcaaacaattctttaggttttataagaatttttgtatacataaatggaattttttaagagattatcaaaccgatatatcccctagaacatgggtaaaactagtagagcaggatattcttatttttgacaagttagttaaatccgattctacgttcaacatattcaaaattgaattttcagataatgccatatcacgtaatttgaatcttgaaaaaaataagaaaataaaagaatttttatttgaacttttacttgataaagaaggtgtcaatttagatgatgtattaataagtataaaaaaggaaatacaacgtttttcacagaataaatcagatcaattttatagatatacatatgattttttaaaatttagattagtaacaattttagataagtatgaaaatgatgatgtaaatataaatttaccagaatataaaagtctatccgatgcgtttcaaaatggccagcgaaatgattatgaaaacagtatgctttattctaaaatttgtttcaattatttagatagaggaagaattgaagattttagtcatacaaaagttgaagcagatgatagtaaagagcgggaaaaacaaaaattaaaagctcaaaaaatacagggattgattctgagcatgaatgaagaataccgaatggcatttatgctatatcaattattttatacggatcgtactcaatgggatgagaatctggcattttacgataataatattcaaagtataatgaagcatggtaagcaataccatggttatttattcgatcaagtgaaaaatattattctaagtgagactgatattgatcatcgtattacagaatcttttttagacaagatatgggaaacaaaaaatgaaacaattatggatttttcatggtttgatcaatttggggatcaacatcagatgtcgaattttaaaattctttacgtacaatggatattatcaggagcgacaacttcctatttgaagagtagaattaattttgaaagagggtttcctattaaagtacgcaattcacttgttggaaaaataaaaggaaaagaaaataggaagatgtcagttaaagatttgaaatggaggattagacgtaaagaagaaaggattggtcatctttgccgagactatctattattaacagatcagttaacgactatttttacaaaagtaccatctgataaacataatttacaaatatcagttgaatatcttttgcacagtggtaaagtgaatttatcggatgttatagataatatatcagtaacaagtttacttcgcttggaatggcttttgagatggaactattatcattatcatagggagtcaaattatactagcagaacattctttgacgaaatgacctctaatgaccgatattattggtctgctggacgtggtattttagaatttttcattgccaaaattgttgacaatttttatcgtgatttataccaagataaagagtttatggctggttttaaatatcatttagagtcacaattaaattcattaaataaaacagttgaagagtatgtggagttgattgctgaaagagtttctggaattgataatctttcaattctacagaaaggacaaattatttccaaattgaattatattttatttggtcaagataataatattaaaataagacaaaaagaaaatatcgctataaataaattttaagagctccattggacatagaaaaacttgagattttatcaagcgttaccaatctggaaatcgtctaaaaataaaaacaagctgactaccaagcaaaatatgatgcgacacaggagcggattgaagagatgaaaaaactggttaagtaggtagaatacaacaaatgcccagcctaaaaaggctgggttttgtggtataataaggttagaaattcaaacaggaggagtctatgcaaccaacttacaatattgataatcccaatctttcctacgaagccaagcaagaactctgggaaacgggttttggtcttcaaaaagtggatgggttgactccgtctgtttatatggaggagttggcggaaaggcaagctcgtggagagtacacctatgagcaggtgtacgaggagattacgaaataccaccagtcaactgacgccagtacgcaagaggcagacattgtctctctccgaattgttgaaatgctctcccaaaatggttttagcctccgaccaaccactctcttacatatccacaaagagctctttcacgatatttttgacagcagtattccagtagttgaataccgcactgtcaatattacaaaaaatgaattagtcttaaaaggtgatacagtgatttattcagattttcccttgattgccgccactttggactatgatttccagcaagaaagggatttttcttatgctaggttagataaaaaagccatcgtcgctcatatccaatcctttatttcaggtgtttggcaaatccacccattccgtgaagggaatactcgaacaatcaccgtatttctcatcaaataccttcgctcacttggttttgagattgataatgagccttttcaaaaacatgcaaaatatttccgtgatgcgcttgtacttgacaatgctaagttagtcaataaacgctcagattttttaactgccttttttgaaaatctcctcttgaacggtcagaatgatttatcaagtgagaggatgtacgaggagttggggttagatgaatatcaataaagacaggatagttttcaagtcggaaatagaccagtgaatacttgggcttttgacttttcgttgataatctcgttaggcaatttggagaaatcgtatgtcctattattatgaaaaattaacgggtaaggttgcaaagcatcttgctcgttttccctattatgctaccgataagattctgaatttaatgcaatttcaagataacaatcagcaatttctgataagtgataagcatttgtatgattactttgaagaacaaaaacatcaactaagtaccgatgaaaaactctccattctgttcaacctatttaagggacgtatagatgtttatgcgaaatcttatattgatgaaaatggaaaaatcaactattttccttcttacaactatggttggaaaaaacgtcctgttgaaaagagaacttgtcaaccattgaccaaacaggtattattggctcacctacgtggcgaaatcagtattggtatttttccaatgagtttatcagacacgtgttcctttttggcgattgattttgataaaaataattggagagaagaggtctccattctaagagatacagcagaacaacatggttttgaggggcatatcgaaatctctcgttcgggcaatggtgctcatctctggtttttcttcgaggaagaaattgcttgtcagcaggcgagaaatgttggaaaaagactgctggaattggctatgcaggagtcaaaagatattcgcttttcttcatttgaccgtatgtttccaaatcaagatattctgcccaagggaggatttggcaatcttatcgcactgcccttacaaggggaagctttcaagaagggaagaaccgtttttgttgataaacattttcagcccttttctgaacaatggacctatcttcaacaggttcaaaagattggacagaagaaaattctagatttcttaggacaggagttttcggatactgtagatgatacagtattagattgtagcttatcaaacgttattcgagttgagaagagggctatttcttcaaaaacaaattacttattgagaaagctggcatcttttcctaaccctgaattttatctaaaacaagcgaccagacaaccaacctatcagactccagaacgcatctatttatttgaagaaacaaacgaagccttgcatcttccaagaggaatacttgctaagctacaggaaatctttgaaacggtaactattagggacaatcgcaacagtttatctccgattcagatttctttcaaagggaggttgcgttttgagcaggaacttgctttggcagatttattagctagtgagaatggcttgctatgtgctgaaacaggtttcgggaagacagttttaggggcagccttgattgcccagaggaaatgtagaacgattatcttagttcacaatcgtcaactgttggagcagtggttggaaaggttgggtgaatttttagagattgaagaggaagaggcagttcgctatactccttcagggcgtgtaaaagtaatagggcatattgggcaatatggggcttctaaaaaatggaggagtaaattggtggatgtggttatgattcaatccctcttccaattggacgtgatttccgactttttgtcggactacgatatgatgattgtagatgaatgccatcatgtgacagccttgcagtttgaaaaagtagttgctcaatttgctagtcaatatctatatggcctaacagcaacgccagagtgtaaaaatggacatcaaccgattgtctttcagcgtattggtccaattttacatactgctcaatcaggtcaatacgattttaaaaagaggttactactccatctaacatcttttgggaaattggacttggaacagtcgaatagtacgaactttgcatcccttaatgattggcttgccaaagatttacatcgtaatactttgatcgtgcaagatattttcaaactatatcaagaaaaacgaaacatccttgtcttagtcaatcgacgggaacatatagaattattggaaaagctacttattgaaaaagaaatgcccaatattttttgtctgagtggagcgagtaaaagaagagatacgaaagaactcctgaaaagaatcagtgagctagatgagaatagtccatttgttctcatttcaacaggaaaatttattggagagggcttcgatatgccaaagttggatacattaattttggccgctcctttgtcttggaaaaataatctcatacagtatgcaggacggcttcaccgtccctatcaaggcaaaactgaggtgagaatagttgactatcttgatatacacgttccctatcttgaaagaatgtaccagaaacgtcagatagcctatcgtaaaatggcctatcaggttggagagaaagaacaaacccaagtattattcagtggtagggactacgaggagaaatttagagaggatttgcggaacacacgttcaacagtctatttacaattgcattcgttcacttctagtaggattcaagaattattgggactgctccgaggaaaacaagtagttattcatgtttccaaaaatcataagttaagtgagtggctaatggggttaaacagtgacaatgtaaaggtgaagcttgtaccagaaaggattggtacgaccgcagttatcttagatagtaatctcgtttggtatggcaatttatcccccttcacatatcagtcggatgaccaagctagtttgttgagattggaaagtcaatctattgcaactgagttgcttgaaaaatttgagaattcaaatattaaataaaaaaatccgaatactgttctgttcggatatttctttaaaaaaagaactgtatttgtattaaaatttaatattttgtataaaaaatatgataaaataatgagaaatggaggtgcatatggaaaaagaagtgtttactcccgatcaaagtcaatctattgtagatgctatattgaagggatacaagtcctatcttgatgagcgaattgaaaagagaagaacaatgcatgtttctgctggttatgtttggactaaagctaatcatatagatggtgctcttgcgactgcaaacctaaattttattgataaatttgagttgaaacatgcgagtcaatcttgggagtttttagaatttaactcagaaaatcaactattaggacgtgtatgttttgttttaaaaggtcttactcgcttgcggcaggtttttccaacagcagtaaaaagtggaaagggctatttatttgactatgctcaaattaatacaagttacctagaaaatctttcaaggcataccgatgaaagtacgcttttccctgttcagatggaattgtttgatgacaatttatttgaacttttgaatcggtctgaacaatctatcaataactttttctttatcacatatcaggctgatgaattacatcacttgacgaatattcaagttatcatgcctgattcaagaactgggaaattgattgaaattcaaaatttatcaacatttatttctacaagtaatgtcgattttaacgatgaaaaatatcaagagttacaaggcttatcagagattgatgatgtagctgattttgagattataccacgtcttgcttcagaaaaagaagcttagaaaggcaaaaaaatgttcaatggttcaagactggaagaattacgacttctgaatggccttacacgtgcagatttggcaagagagcttgaagtgaccgaacaggctatatggcaatttgaaactggagttacacttccaaaaatgaaaaataagatagcaatggctcgtttttttcaggttgaagttgactattttgatgctgttgataagaatggttcattctcactaagtcgcattgcctttcggaatgcagaccttgaggcaaaaaaaaacatccatatccaaatggtatatttggaaaaaatgaatcaaatgatagattatttggagaactttgtatccattcctaatcaaataatttaccagttagttgatagtattgagcaaaaacttcagcaacatgaatcacttgagtttattgctgatcatgttagagaggtattggcagtatcaattgataatgccaatctcctctatagtttagaaaaatctgggatatacatttcagagagattaatcaatggaaatgcggatgcctatagtgcttggtcacgtaatggtcgaccttttatcgttttgggactgggaaaatcagcggtacgacataattttgatttagcacatgaactagggcatctactcttgcacaaccaagtagattttgaggaactgtcaaaagaagaattagaggaaaaagagaaagaagccaatcaattcgcctcctatttcctgttacctaggaaacaatttttaatggattttgtgaatattgtaggtaagcgtgtcagcaatcctgatcaatatatcttgttaaaaaaacgttttggtgtctcaattcaagcgcttgaatatagagcctacaagcttggcttactgactccacagcaaaattcttatttctatcggcagatttcaaaaaaaggatataaagcagttgagccactagatttggaaattcccttaaagaaaccaagtaaaatcagaagtatcttagatgtcatcctttcaaacaatcttttaactctgtcagatattgaacgaaatcagagggtgtcaaagaattttatcagtcaattattttcatttgatgtgaaattttttgataagtatttgcttcaattagatacgtttgataatgtaattccattgttttctagaaaacaatgatggggagtagagtaatgaacaaaatcaattcttacaaaatccacctcccctctctcctccctttcggtttccttttcgccaacaattgttacacctaccgagaggtgtttatggaggggcagtttgaggcggtggtggaggttgatgaggctggtcagctgtcgtcctatgtttgggattgtgagatggaggaggtctataccgcccatctggtgactgcgccatctggggcttttgtggggcaggtgagagaaagctatcagtccattttggatcgagtagaggaggcctgctgtatcgctctaccatttaccaaagaccaaagcaaccgcatagcccagctcattaaggagcagtggggcgaccttcctgactatccctttgccaagttgccgacctatggggcttttcgccaccccaacaataacaagtggtacgccctggtcagtcagattccgagggacaagctggatgggagcggttctcaagaagaggtggagattgtcaatctcaaggttgccggtcgggaaatagcagagctgttgagtcggtcgggcatcttccctgcctaccatatgtcgaagaagacctgggtgtcagtcttgctggatgatacggtggaggatcagacggtgtttgctctccttgagaagagccgttatctggtaggaccaaaatcctacaaggcgacgcaagggcctgattactgggttattccagccaatcccaaggtctatgatatcgataccgaatttgcagaaaataaggtagtctattggccacaaaaatcaaccattcaagtcggggacatcgttgccatttatgtcacggcacctgtacaggctattcgctatgtttgtcgagtcttgggggaaaacttggaaaatcatggagagtcagatattccaacagaaaagaaactcatgcaggtggaattgcttgctcagttttccgatgatgttttgccgagagcgcgcatgatggacctaggagtgaaagctgtccgtggacctagacgcctcacaaaggagttgatagacgttctgacatcagaagtgataaatatttattaaattatcagaatatttaataaaaatctttacatctgcaaaaaaagcggtataataagactattaaaatttaaggaggagtaggtatgaagaaaagcttcattcatcagcaagaggagatttcttttgtcaaaaatacatttacccagtatttaaaagataagctagaaatcgtagaagtgcaaggaccgatcttgagtcgtgtcggggatggtatgcaggataatttgtccggtgtggagaatgcagttaccgttaatgtgaagctgataccagatgctacttatgaagtggttcattcgcttgcaaaatggaagcgtcataccttggctcgctttggatttcacgaaggagaaggtctttttgtacatatgaaagccttgcgtccagatgaggattccttggatccgattcactcggtgtatgtggatcagtgggactgggaaaaggtcatccctgatggtcgtcggaatttagcttacttgaaagaaacagtagagcagatttacaaggctatccgtctgaccgaattggccgttgaagctcgttatgacattgagtctgttttaccaaagaaaatcacctttattcacacagaggacttggtgaagaacttcccagacttgacaccaaaagagcgtgaaaatgtggttgccaaagaatacggtgcggttttcctaatcggtattggtggagaactggcagatgggaaaccacatgatggacgtgcaccagactatgatgactggacaagcccatcagaagcaggctacaaaggactcaatggagacatcttggtttggaacgaagcacttggatcagcctttgagttgtcctcaatggggattcgtgtggatgaagaagcgctgaagcgccaggttgctattacaggtgacgaggaccgtttggaatttgattggcatcgtgctcttttgaatggtctcttcccgctttcaatcggtggcggtatcggtcaatcccgtctggccatgttcttgcttcgtaagaaacatattggtgaagtgcagtcgagtgtttggccacaagaagtgcgcgataattttgagaatattttataagagattggcttcaatctcttttcttctgctttcaatctgctatctgaaaacatttacaacaagattatctgtgatttttgcgccaatctatgatatacttttttagttaaattaaaatatatagaggatattatgacaaaacttagagaagacatccgtaacgttgccattattgcccacgttgaccacggaaaaacaaccctcgttgatgaattattgaaacaatcccaaacacttgatgaacgtacgcagttggatgagcgtgccatggactcaaatgacattgaaaaagagcgtggaatcactatccttgctaaaaacactgccgtagcttataacggtactcgtatcaacatcatggacacaccaggacacgcggacttcggtggtgaggttgagcgtatcatgaaaatggttgatggtgttgtgcttgtcgtggatgcttacgaaggaactatgccacagactcgtttcgtattgaaaaaagcccttgagcaaaacttgactccaatcgtcgttgtcaacaagattgacaagccatctgctcgtccagaagaagtagtggatgaagtgcttgagctcttcatcgaattgggtgcagatgatgaccagttggaattccctgttgtttacgcgtcagctatcaacggtacttcatctttgtctgacaatccagcagaccaagaagaaacaatggcaccaattttcgataccatcatcgagcatatccctgcaccagtggataactcagatgagcctttgcagttccaagtatcgcttttggactacaatgacttcgtaggtcgtatcggtatcggtcgtgtcttccgtggtactgttaaagttggtgaccaagttaccctttctaaactagatggcacaacgaaaaatttccgcgttacaaaactctttggtttcttcggtcttgagcgtaaagaaatccaagaagcaaaagctggtgatttgattgctgtttctggtatggaagacatcttcgttggtgaaactgtgactccgacagatgcagttgaggcacttccagttcttcgtatcgatgagccaactcttcaaatgactttcttggtgaacaactcaccgtttgcaggtcgtgaaggtaaatgggtgacatctcgcaagattgaagagcgccttttggccgagttgcaaacagacgtttctctccgtgttgaccctactgactctccagataaatggactgtttcaggtcgtggtgaattgcacttgtctatcttgattgaaaccatgcgtcgtgaaggctatgagcttcaagtatcacgtccagaagttatcatcaaggaaattgacggcgtgaaaatggagccattcgagcgcgtgcaaatcgatactccagaagaataccaaggttctgttatccaatccctatctgagcgtaagggtgatatgttggatatggttgcgacaggtaatggtcaaactcgtcttgttttccttgtgcctgcgcgtggtttgattggttattcaacagaattcctttcaatgactcgtggttacggtatcatgaaccatactttcgaccaatacttgccagttgttcaaggtgagatcggtggtcgtcaccgtggtgcccttgtttctatcgaccaaggtaaggcaacgacatactctatcatgcgtattgaagagcgtggtaccatctttgtaaacccaggtactgaagtgtacgaaggaatgattatcggtgaaaactcgcgtgaaaatgacttgacagttaacatcacaactgcaaaacaaatgaccaacgttcgttcagctaccaaagaccaaacgtctgtaattaagacaccacgtatcttgactcttgaagaatcactagaattcttgaacgatgatgaatacatggaagtaacgccagaatctatccgtcttcgtaagcaaatcttgaacaaggcagagcgtgataaggctgcgaagaagaaaaaattagcgactgaggaataatttctaggagaagaagcatgttttatttaatcctcgccatcatgttagtacttttttatatttttattgcacctagcaatattaaggggactatgaatttgattgcggcagtatttttactggtagcattagcgattgccttggtacttggatttttaagaatcatgcaatttccaaaggaaatttgggttggtctactaatgattctgattggtttttgggcgatgcgggatatttatcaattaaatgacgatacaaaattttagcagagtctttgatttttgaataccgtaatacgatattactaaggaattttatccagctttttggacagtagtggcaatctattagctaaagaaattatattctgtgatacatcttgaagaagctctcgttatttataataaatgacaagcgcattttcaaggtgtttttatgtagataaattttaatactcaatgaaatccccaaaatagcaagtttttagtacagtcatttaaattaactctgatacatcgccgctttcagcttgccgcactctacgaaagtgactcgtttcgcatgtcttatttccaacctagaacagcctctaggctgttctagctacctgcacatcggttccttgtctgaaagctaattcattagaccatacaaggcaatgagctgccgccgccaacttttatcaacatcttagcaatttgcgttttacagtctgaagctgatctctataattgacgggagtgggaaagacatccatacattaaagtaattaaagacaaattaaataactatattagtcattcaaacctaaatgagagggaattgttttataaaatattgctaacagttttcccttagacaaactcatattactagacaataaatggaaactatagtaaaataccaagtattgttattaagttgtactttaacttagttgtataatattttggtaaaagagaggaaacgcagatggatgtaaaaaatcttcggaaattaaagcgaattgagttatatgagattatgttggctcaaagtgaagagattgattgcttgagaaatcaacttgagaagattaaaacagagttggctgatagaagaattatgattagtcaatctggctccatagcggaagcttcaatgaaactgactaatatttttgaagaagcgcaaaaagctgcggatctatatctctataatgtgaaaaacaaaattggtgatgttcatgaatagttcaaatctcaagggaaaggaacttccaaaaacttcagaattaaaagagctatatcagcatgaaagatatagacatacattttggaggacagtgaaaagtacagtgtttatgttggtagtagttgcagcatttgcaatactaatcgctgtattatttttgcctattttgagaatatacggagattcaatgaaaggaaccctgaatagtggggacatcgttgtatcagtaaagagcaatgattttgaaagcagtgatgttgttgctttttattacaataacaatattctggtcaagcgcgtcatcgctgaagctggggattgggtggatatggataaacaaggaaatgtttatgtcaataatcaaagattggacgagccatatttggcaaatagggattatggtcatacagatattgagtttccctatcaggtaccggaaaatcgaatctttgtcatgggagataaccggaaagagtccattgattcgcgaaacaacgctattggtacagtctctaatgaacagattgttggaaagttggtatttaagatttggccactgtctgaattgggatggattgaataaatgaaagtgaaaaaatagaaaggaggatcttgtgagagactggttaaatttagaaaaaatccaaggttggcgacgaaagtacaagaagctcgtgaatatcattgctttcctcgtagtatttgcaacgacctatgctttgattctacccgctatcacattagaccaagaaaaggctgaataaactgctgggattgaagtgcaagaaacaccagtaacaacggaaattagtaaattaacagaaccgatggtgacaactcagcaaactccgatagtgggtagctctgctgatgaagttcaatctcctgcgacagaaacggttcctgaccctgctgagcaagtgtcaacagagtctgctagcaaaccccagaccgaccaagaacggattactgagccaactaccatagttcacaaaacgaatgattatgaggtgactgcaacatttgatgcgagtgctcaatttcccaaagatgttgagtttaatgttagagaactagatagccaatcagaagaatatcggacacattatgaaaaaaccaaggagaagcttggagtaaaaaaacttgtatatgcccgattctttgatattcatttttcatcacagggccaagaggtcgagcctgcctcccctgtgaagattacgattagaaacaaggaattagttcaacggccagatgatagtaaactgaaaattgtccactttgaagagaatagccagatagaagttttagaggccgaaacgaaggaaaatgaacaacaaatctccgagatcagttttgacgctagccatttttctgtttatggagatgttttagcaaactattatactgtcaaatttacctacactgacacagcaggtcaagaacaagtcattacgagtttgattgataagactgtggggacttcacttggtagtttgcctgaagctccttttaaaaacggttatgtattttctcattggattaataaagatactggtgatcggattgatgaaaatacggtgataactggcgacctgactgctgtagcagtatttaataatatcaatatctacaccattgatgtcacgtatttctaccacaatgtttctaaaaaccaagatattacgattgataaggaaacggtgcaactggaagcaagtgatgctccatatcaactgacaccacctgcttctactgaggtgagcaacaaagaggatacaactttaccagcagatgctatttactaccctgaaaaaccacttcttgagtttacagcagatcaactagagcgactggacgtagcagatggagtggatgataattatattagcgaaagagtacaatatgttccttacaatgcagagtatgatgtcatttataggctaaagaatttgacggggtcaggttattctgatatccagactgttcatgtccgtggggtactgggttcaactgttacaccgcaaattctaacctacaactatgctgactttgaacgtgctgatacagcaaagattgagaatactagcggccaaaaattgtatgtttattatacacggaaaacctttactctttcttataattccaatggcggtagtaatattccccaacaacagggtctatacgatagccagattaagatttctacaactactccaacaaaagaggggtatacatttgaaggttggtatgataatcctggactgactggaaacaagattacaggctctctcaccttaaagaaagatacaactttgtatgcgaaatggacaccgaacagggttcgctacatcattgggtattacaaggaagtctatgacaacaacactggaacaacctcctatgtatatgatagttcggcagctggttggggtctggttgggactactgtaaaaggaacagattcaaatattggacctcctccgccaacccaaacaaccattggcagcattggctacgagaaggatgttactaaaagtgctgcttcaagtattgaaattgcagctgatggaacatctgttttgaaagtttactataaactgaagcgctacacttttgaatttttcttaaatgataacaatgccaatatcaccataaatggtaagacctactctgataggaataggtacatgatacgtgatgttgtgcttggtcaagatgtctcaaagttatggccagcttctataacaaatcctaaagaagtatacgatgataaagtctactatgatagctatggtaggccgataagatacttttttgactactggatttttgggaatctactcttcaaaacagatcggttcgaagttgttgagtctatgttgccaacgagtggaacaaccagtaagttcacagcatattggaatacccaaggtacacaggctaacgttgaatattggttacaacaaccggatggttcttataagaagtctgatatatatagtcaatctttcctaaagactgcaggactgctaccgaaagaaatttttggatattcttattatacagatgctagttttactgaagcaggcattaggtattacggaactcaaggaaatacatatcgtttctactataaacgccaagccttcaaaattgactattattacaatagtactgggttagattcaaagagtaacattctctttgagagtaacatcaatacagcaacttataattaccaaccaccacgttctactggagttgatgctgattatacatggggtggatggtatacagattcgttattgacagagaagtataactttaataagatgcctgccaataacttggttctctatgctaagtggattgctccaaaatttaaggttacttttgatatcaacggtggtaatggaactgcccctgtcgatcaaagtgttgaaaaatacaaatacgctaaggcccctgctgatccaacgagggaacattacaatttccttggttggtctacagaagatgggaaactctatagttggagcgaccaagtaaccaaggatgtcaaattgactgcgaagtgggaattgaaaccattaacttatactgttcgctatcttgaagcaggtacaaatacgcaattggctgctgataaagtgattacgagtccagcgcttgtattgaatcaagctatcacagaaaaggcattgggaattacaggttatcgaccagataagagtagtcaaacaattaacctgaattttagagggaacgaaataactttctactatacaccgaaggtaaaagatgttgtttacaccatcaagtatgtcttgaaggataacccagctattgaggtagcacctacagttactcgtaaggttgatggaagtatcatccgtgcgaaagaagctgctgcagatgtgaataaacagcatttgcagagtcagtctggtgttactgctgaaatgctggaaatggattactatccaactgtaaatactcaaagtttgattctaacttctagtgatgcaaataatgtgattgtttttgaatatgtcggattcgatactcaaacctttacggtaaattatttggatatggatggtaagaaaatcgatggtcaagaaccattggtagtttaccgaaagaaaccaggtagtttcgtggtagatcataagactataaatggttatacctatgatcattcgttagacagtgagaatgcagctgataagacagtataccgtgtaagtaagggtggtcacataaccattgatctctattataagaaaaacctaacactgaccgcattagataagtccaaagtttatgatggcactgccctatcaagttcgggtctgtctgatttaaatccttcgtacagttcagaactgaaaacaggtgacaaattggttgccatcagctatgatggaagtcaaacaaatgctggtagtagcgcaacgacacctaaacttgctaacatcagcaatgcatctggtgctgaccggacgaatttctatcacataacctatcaaccgggtaacttaagagttgaccaacagccagttgtggttgtcatcgacggtgaaaagaaatcgaaaatctatgatggcaaagcagaagcagttggttataaggtgacggaaataagagattcaagcggtctctataaaaaaacagatatcaaatttaatggttcaagttcagagcagtcggttaagaaaaaagatgcaggaatttatccactccttttaagtaatagattctcaaataccaatcagaatttccaagtagatttcttgatttctgatggggaattaagaatagatagacggcaactgaccataacatctgactccgctagcaaggcttatgacggtagcgagcttcgtgctgacaatatcacagtctctgtacctgctggtgttgactacacaggttttgtcgatggcgaagggattataccaaccttcttaggcggtccaatcgattctggaatgatgccaaacttctttgaatatgctctaaaatctggcacgaatttagctaattatgagttagatatccagtttggccagctcaaggtcaaagaagtcatcaagattcagaaaacagacctggcctggcaggccctttcaggtggtaagtttgaattgaccaagtgggatggtttgaactgggctcaggtagatggggtgcaggaatttgccattaccagcaaagatggtattcggataccggtaggcttagaagcaggtcgctaccgtctgcaagaattggcagcacctgatggttttatcgtcttggatagctatatctacttcagcatcaaggaaatctttaacgaagataagacatcttccttctacacagtttccttgtctgatgaagcaggcaaggatgctagtccggaacgagcaacgcttaccaaggttagtggtgatgccagtcatcgcatccaagtggccaatgagcagggcagagccttgccaagcacaggcggagatggacagaagtggtttattctttctggccttgtcctcatagccatctcctatctgatgcatctgtttgttcaacgtcgaaggtaaaggagacagtaacaatctccaaatcccttagtagtaaatcgtctcagctttctaagtaacgtccagtttcttagacctaatccaaataaataaaagaaggaatattatgaaaaaattacaacaattctttacatcccttgtggcagtactgacagtcttcgcttttggttccacggccttggcgcaaactgttgatagcggaaaaagtggagcaggcactattactgtctctaacgcttcacaaggtcaaacttacactgcctataaactctttgatgcaactgtaaccacagatggttctggtatctcatacaaacttcctgctggtaaaattgcaacgaactttggtggtgatacttggttcgaagtggacagcaaaggtaatattactgcaaaggaaggtgctactgtctcttcagaagcatttgcggcttgggcaaagaatttcggtacagaagttacaagtgctacagcgaatgataactctcttgtgtttacacatttgacatttggttactattttgtaacatcatcacttggtgcagtgcttacagtagatagtacaacaccaaatgcaactgttatcgataaaaacactactaatccaaccattccagattcaaataatggtggcggtaagaaaattcttagcaatggtgctacaactagtgaaacaactgcaaaaattggcgataccatcaacttccaaatcaagtttaatgctaccaactacgttactaaagatagacaaaccaagcagattgtttcttacactatcgaagatagcccaacagccctcgcaattgatcaaaattctgtcaacgttaaagtggatggtgtggatatcacagcaaaaatttcgaagacttttgatgcaacaggcaaaatgaatcttgtcattacatgggcggatgcggcagctagtaataaaaccatctataactctccagctgaagttattatcacctactcagcagtggtgactaaagatgccaaggagggagaagcaaccaactcagcgactattggttacaacacaattgataatccaacaactcctccaacaccagttgatccagacaagccaactgaaacaacaaaagtgactactcaccgtttcactttgaaaaaaacaaacaatgtaggtgaaactttgacaggtgcagagttcaaactctatgatgcagccaacaatggaactgaaatcaaggttgtcaaggaatctgacggagtgtatcgtgttgcgcaggctgatgagcaaggtgttgtcatcgaagctggcgaagttgtgattaaaggtctgaaacatagcacgacctattatcttgaagaaatgaaagcaccgaatggttacaatatcttgacagaacgtcaatccattgaagtgaaagagaataacacagcacaagcaaatatcgtcaataaaaagggtggtgtcttgccaagcactggtgcgattggaacaactttattctatctagttggttcaatcctacttttggtagcattggtttatactatttcaaaacgtcgtatgaacaatatctaattgtccatacaatacctaatatttagaatctatcttcggaagtgcaaaagcaagagtggaagtatttccgaagatatttctttggtcttaacacaaggaaaggaggggatttcatgatcaaatggctcaaaaagaaaggtccgtcttttatcatgccattaatttttatattggggattggactattggcttatccatcggtcagtgattactggaattccttccaccaatcagaggccatcatgtcctattctgacacagtatcagatatgacagctgaccaatacaaagaaatcattgatagtgcgcgccagtataatcaagaaaaacccttaaactggaatgtgactgcatccgacattgaagcctacaatcaggaattgaatttcaataaagatggcatcatgggctatattgagattcctaaaattgatgtcaagttatctatatttcatgggacagacgaaacggttttagagacttctattggacatctagaaggaacatcgttgcctgtaggaggtttgggaactcatagtgtactttcagggcatcgtgggctcccatctgcccgtctgttttctgatttagataagttgagagaaggcgatatatttaccattcacgttctcaatgaaacactaacttacaaagtggaccagattcgagtggttgagccatcagatttatcggctcttaccatggaacctcagaaagacttattgactttggtaacctgtacaccctacggtattaatacacataggctattagttcgtggctatcgtattgaaaatgttaatggtagtgctttggttacctctgatgctatccaaattaaagcaatttttattgctccatttatcgcaactccaattctatttgtaatcttaatttatatttttataacaactagtaaaacatttcgttctcggaataggaatcaagtgttggatgattttttagttcccaagaaattttgaactattgaaaatgtttcaaagtcgatttgactctggaacatttttctattatagacattagacaatatggctgaatgaggtaattgttcaacttctaacctcctgtcaactcaaatcaattgcctagaccgacgattgaaacgacttctttctagtaactgaccgcaagggaagaggtggcagatggtgtagaaatggcgctgtgatgtcatacctagttcagcttgtaacaaaagtaagacaaggattgattcatctgaaactttaactaagccaacatttcgccgatatttgaaggaatccgggcaatagttgttgtagaagtgatgacaaatttgtgataattggcgtacattccattgcaaatgatgagatttagcagtatactgtaagtagctcatttggactacccctctgtatgtttcgtcgcttacagtatagtccatttgggctttttattgtattttgaaatgaactagcgctacgggcagagtttacttttctgtcctctggcttgaaaaaggtcttcgtaaagggtaaaataaggtgttagaaagtaaaggtatttgagatgaagatgattgatattgtaaaaaataagaaagtgttagtgctaggtttagctaaatcaggggaatctgcagcccgtctactagataaattgggtgctatcgtcactgttaacgatggaaagccttttgaagaaaatccgactgctcaatctttgttggaagatggtatccgtgttatttgcgggagccatcccttggaattattggatgaagatttcgctttgatggtaaaaaatccaggaattcgctatgataatcctatggttgaaaaagcaattggcaaaggaattccagtatggacagaggttgaattggcctacttggtatcagatgttccaatcgtggggataacaggttcgaatggcaagacaacgacaacgaccatgattgcagaagtcttgaatgcaggaaaaaaacctgcaaaattatgtggaaatattggctatccagcatcttcggtcgctcaaactgcgactgcagaggataccttggtgatggaattatcgtctttccagttaatggggacagaatctttccatccgcatatcgccgttgtgaccaacctcattgccagtcatattgattatcacgggacttttgaagactacgtagcagctaaatggatgattcagcgtcagatgacggctgaggattttgtggtgatcaacttcaaccagaaagaggctaaggaattggctggacagaccaaggcaacggttgttccattttcaacacaggaagtagttgatggagcttatttggcagatggaaaactctatttcaagggtgaatacatcatggatgctgaccaaattggtgttccaggttcacacaatgttgaaaatgccttggcaacaattgtggttgcaaaattgttgggagtagatcagcaagcgattcaggaaagtttgtctgcctttggaggtgtcaaacaccgcttgcaatttgtaggtgaaatcaacggggtttccttctacaatgatagtaagtctaccaatatcttggcgactcaaaaagctctttcagggtttgacaatagcaaggtcattttgattgcagggggcttggaccgtggcaatgaatttgatgaattagtacctgatttggtcggactaaagaaaatggtgatccttggtcaatcagctccccgtgttcaacgtgctgcagataaggcagaagtggaaacgatagaagctctcgatattgcggatgcgactagaaaagcctttgccattgcggaaaaaggagatattgtccttttaagtccagccaatgcaagctgggatatgtatgccaattttgaagtgcgtggcgacgtcttcttacagacctttgaggagttgaaataatcatgaaaaaaattgtttttacaggcggagggactgttgggcacgtgacgctcaatctccttttgattccgcgatttttggaagaaggctgggaagtccactatattggtgatgggaacggtattgagcatgagcaggttgtgaaatcaggtttagatgttcatttccattcgattgcgaccgggaaattgcgccgttatttctcttttcaaaatatgttggacgtgtttaaagttggttttggtgttcttcaatccttgaccattattgctaaaattcgtccgcaagctcttttttcaaaaggtgggtttgtatcggttccgccagttattgctgctaatttgctgcgggttccggtctttatccatgaatcagacttaacaatgggactggccaataaaatagcctataaatttgcgactaccatgtatagtacttttgagcaacctgccagcttgactaaagtaaaacatgttggtgcggttacaaaagtggggcaaacgaatgacaaagttacaccaattcagttgccagaaattctcagtcacttcgataaaagtctgccgaccctactgtttgtaggtggttcgggcggtgctaaggtctttaatgatttaatcagtcagaatagtgctgccctgaccgaacgattcaatattatcaacttgacgggggacagtagtctcaacaaattagataaaaacctatatagagttgactatgtaacagaactttatcaaccgttgatggatttagcggatgtcgttattacccgtggtggttccaatactctgtttgagttgattgccatgcaacaactccatttgattgtgcctctaggacgacaggccagtcgaggagatcagattgaaaatgctctctatgcagagaaaaagggatattctaagcagattgatgaaagtcaattgacatttgccagcctgttagtagaagtcgatgagctattgaaacataaggaattttatgtccaaaacatggcaaattctaatgaaattcagtcagtagatagtttttacaatttgcttagagaagatatgggaaggtaggttctatgacggaaaaagattcaaatgtagaagaatcagtgctagaagtggaacaggcatcccaagtagaattggattccgaacaaatttcaccagcagagaaagaatctgtattagccgaagagaaagaattttctacggatgtagacatacctgagatgactgctccggatgatgaaaaaagtgcctttttcgaacaatggaaagcacgccaccaagcctaccttgctcataaagatgaggcagatattcaggcagttgacgagggacagacagaacaggagatcccagaagctaaaaagagtaaaagggtcctttttcagggaatagaaagaaaaacagagagtctgaaatctaaaaaggaaacaggggaaaaggttcaaactttaaaagttgatattccttccaaagtagtctggaaagctattccggttcttgtgacgagtttgttactggcagctctagccttgtattttatttctccaaccagcaagaaaaaacaaatagaggttgtcggaaatgagcgactaactgctgagcaagtagaaaattatagccttatctctccggatgattacaatgtgactatagctttgcatgcagatgcttacgcaaagaatattaagaagaatagttcgtccgttgagacagcgacaatcaagttccagtttccagctacctttaccattcacatcaaagaatacgcaataataggctacattcagcaacaaagtcagtggtatccagtattgtctagtggagagattggcggtgaaccgatttcacaggattccttgccagaagactatacaacaatcaatttatccgacaaggaattaatcaaggaactggccattgaattgggtaaaatagatgcaggaattcgttctgctattcagacaataaatttaacgccaagtaaagtgaccgcggatttgctgacattcaatatgagagatggaaatactgtattagtcccgttgagtgagattagccagaaggtgtcctactatacaaaaatagcagcagaagtgactgttccaacaacaattgatatggaagttggtatttatagatatgcaagctgaaatagataattttgtaaagaaaaagtaataaaaaaatcctttaaaaacaccataattcgatataatatggtataatgaatgatgactaattatactatttttcaaaatggaagatgatttgttaaagttggaagtaagagaggactgatagaatggctagaaacggcttttttacgggattagatattggtacaagctccgttaaagtcttggttgcagaatatattgataacgaaatgaatgtgattggggtcagcaatgtaaaaagtgctggcgtcaaagatggaattattgtaaatattgaggtggctgctggagcgattaaaaaagcgatcgagcaggcagaagaaaagtcaggtatccgcattgaaaaggtaaatgttggattacctgccaaccttcttcagattgaaccgactcaagggatgattcctgttacaacagattcacaagaaattacagacttggatgttgagaatgttgtaaaatcagcattgacaaagagtatgactccggaacgcgaagtgatttcatttattccagaagagttcactgtcgatggattccaaggcattaaggaccctcgtggaatgatgggaattcgcttggaaatgcgtggtatgctgtatacaggcccacgtaccattcttcacaatcttcgtaaaacggtggagcgtgcaggtgtccaagttgaaaatattgtaatttctccgttggcactaactcgctctgtattgaatgaaggtgaacgtgagtttggtgcgactgtcattgatcttggtggcggtcaaacgactgtggctgttatgcgtggccaagagttgcaatatacaaacatctaccaagaaggtggagattatatcacaaacgatatttcaaaagtattgacaacttcaaagagtattgctgaaaacttgaaatacaactacggcattgcctatccgcaagatgcaagtgataaggaaaaatttactgtcgaagtgattggagaaaacgctccagttgaagtgaccgagcgctacctttcagaagtgattgcggcacgtctgcgtcagatttttgaccgtgtgaaacaagatttggagcgtacacgtgctctagatttaccaggaggcattgttcttgtaggtggtggtgctatcttaccaggaattatagaattggcccaagaagtgtttggtgttaacactaagctttttgttccaaatcaaattggtatccgcaatccagcatttgcaagtgtgattagctttgttgagtatgttggtgagttagaagatgtagaaaatattgcccaacatgcagtaaatggtgaaactaccttgagacataagccagttgaaattcctgttgctcgtcctcggattagtcagccaattcaaagagaaatcgtgaacgaattgaacacagttgatcaggtagaggaacaagttgctcctacttaccatgatgaggaagaagaagttcgtccagctgctaagggaaacatcacagatcgcattcgtggtttatttggcagcatgtttgaataagagaaaagaaaaggtgatttaaactatggcattttcatttgaagcagcagctagtcatggtgctgtcattaaagtaatcggtgtcggcggtggtggcgggaacgcaatcaaccgtatgattgaagaaggtgttgctggggttgagtttattgcagcaaacacagatgtacaagcgctaagtagctctaaagctgaaacagttatccaactaggtcctaaattgactcgtggtttgggtgctggaggtcaacctgaggttggtcgtaaagctgctgaggaaagcgaagaagcattgactaatgtattaactggtgcagatatggtcttcatcactgctggtatgggcggtggctcagggactggtgcggctcctgttattgcacgtattgctaaaaacttgggtgcgttgactgtcgcagttgtgactcgtccgtttggttttgaaggaaataaacgtggaaactttgcgattgagggaattgaaggtcttcgcgaacaagtagatacacttttaattatttcaaacaacaaccttcttgaaattgttgataagaaaacaccgcttttagaagcactaagcgaagctgataatgttcttcgtcaaggtgttcaaggaattacagacttgattacaaatcctggtttgattaacttggactttgcagatgtgaagacagttatggaaaacaaaggaaacgccttgatgggtatcggtatcggtactggtgaggaccgagtgattgaggcggctcgtaaagcgatttattctcctcttcttgaaacaacaattgatggtgcagaggatgtcattgtcaatgttacaggtggctatgacatgactctgacagaagcagaagatgcttcagaaatcgttaatcaggctgcgggtcaaggtgttaacatttggttgggtacatctattgatgaaacaatgaaagatgagattcgtgtgaccgttgtggctacgggcgttcgtcaagatactgctgataaaccagcccgccatcgtacggaagctgtttcaccacgcccttctcaccgctttgatcattcagtagcatcagcaccaactcgtggagctgcacaacaaactgaagcgccgaaagcttctgccttcggagagtgggatttgcgtcgtgaaaacttgattcgtccaactgacacagaaccaacatccactgtttcagtcgaaaaatttacaatggatcaagatgaggatgaattggatacaccaccattcttccgtaatcgctaaactaaaatgaattttcaaaagaataaggatgctatcttttcagcagttgcaaaagctgctgagaaggcaggtcgtccaagtgaatcagtaaaggtaatagctgtcaccaaatatgttgacagctctattgctaatcagctagtgaatactggaattactcatattggagaaaatcgagtcgatcagttcttagaaaagtataatgccctagcagacaaacaattgacatggcatttgatagggactttacagagaagaaaggtcaaggacattattccatttgttgattatttccacgccctagactctgtcaaactagctcaggaaatagataaacgtgcgactaaaatagtcaagtgtttcctccaagtcaacgtttccggtgaggagagtaagcatggctttgcagtatctgagattgatgcggcacttgctgaaattagtttattggagaacattgaacttgttggattgatgacgatggcaccgattgatgctacagatgatgaattagacgagatcttttctaaaatgcaggaaatccaagaagaactagctacaaggaacttaccacgtatgccctttacagagttaagtatgggaatgagtggggactttgaacgcgccattgctcacggagctacatatgtgagaattggctcagcattctttgaataatggagaggaggaaaatatggcattaaaagatacatttaagaacttatttaattactttgaagttgacgaagtcaatgaagttgaagaacaggcagatgcctattcaatgcctaatgatcgtcctaaaatgcgtgttgccaatactacagttgcacctgtgcgcgaacagcagccaaaagtagagacgcgtcgggaagcacgttcagaaagtcaacttcaacgcctacatgaaaggcagcaagaattgatgactaataataacgaaaaagagattgtcaaaactacaattgatattaagtttccaaaacgttatgaagatgcaccagagatggtaaatcttttattagacaatgcgagtattctcattgattttcaatatatgtcggagcaacaagcaagacgttgcctagactacttggatggtgctcgttcagtattatctggaaatttgaaaaaggtctcaaataccatgtggctgttaactccagtaaatgtcacagtcaatattgaagaattgcgcaatgctggtacaactactggtgtggctgattcaaattttgaatttgatataaaacggtaacgctatgcaaattttgatttttttactattaaaaattgtagaaatttattcttatctcttattggcatacgctttgctaagttggtttcctagcctatacacaagctcgattggtcgtttgattcaatggctggtagcaccgattttaaaaccctttaggcggttaaatctgcagtttatggggttggattggaccgtaatggcagccatgattgcgcttaatatgggaacacgcttcttggttcaattattgctcctgttagcatagttatgaaaaatgacaaaaacttattgcaacatttttctagggaagaaagagagtttgtagagaaaataatggatatgtgtcagcaagttgaagatacgtattcatacagattaactcactttttacatcctagacaagatgaaattgtatgcaaaattgctaactactaccagttacaaacgttttctagtcgtgaccttgtttcgacagaacattcgcgggttattattgccccgacttattatgagttggacatcaaggactttgagttaaccgctcttcatttgtcctatgctagaaaatttcacaccttatcccattcacaagttcttggaacttttctcaatcaactagggattaaaagggagtatttgggtgatattttgattgatgatgaacgattgattgtctttatcgatcagaaatttgggcagattgccttacaatctatcactaaagttgctcgtgtccctgttaagggaaaggaagaagaatggacgactgttcgactaccgattggacaggaatggcgttcaaaggatgtgttggtttctagtatgagattggataaattgatttcggtcgcatttaatctttcaagggcaactgcaaacaagttgattgaggctggacatgtgaagttggattatgttctgacagaacaaaccagtaaattagttgaaatagggcaattaattagtgttaggagatatggtagagttcgcctaaatgaatttttaggtttttctaagcaagggaagataaaattaaagttagacattgttaaaacttaggaggaaagatggcacttacagcattagaattaaaagataaaacctttgctacaaaatttagaggatacgacgcagatgaagttgatgactttttggacattgtaacacgtgattatgaggatttaattcgtaaaaatcatgaccaagagttagaattgaaaaatttgcgagaacgtttggcttattttgatgagatgaaagaatcattgagtaaatcagttcttttagctcaagatacagctgagaaagtaaaggttgcggctgaagatcaagcggcaaatattattaaacaagctgactatgatgcggcaacattgttacatgaagctaaagataaggcaaatgaaattcttcgtaatgcgactgacaacgcgaaaaaagttgtcattgaaactgaagaattaaaaaaccagacacgtattttccatcagcgtctaaaatcaacagtagaaagccaattatcactggttaattcatctgaatgggaggaaatcctccgcccaacagcaagttacattcaaacaagtgacgaagcctttcgtgatgttcttcataaggctttggatgaagaattacctgttgaagaagaaagtttggattatacacgtcaattgacaccagaagagattgcagaattaactcgtcaggcagcagcttttgagagtggagaatctgtagtactttcaatagaagaataatagaaatcataagcaaagacaaggtcgttagaaatattttaagcgagtaggagatggtggaagccctacaatctctttctatggatcatcactttgtttgatctttcctgaaaatagtaaggagagacgtccgttcacgttacgaacatagagggatagaggaaactctatctaaactaaggtggtaccacgaactttcgtccttatttggcgggagttttttatttttatgatacgattagaattagtaaacaaggataactttgaagtagtgttacaagttcaacttgcatctgaggaccaacgccgagtggcatcggttgaatattctttagcccaagcttggttatataaagattcggggatgattctaccatatgctgtggtatctggcagaaaagttgttggttttgcaatgttatctattgaacccaaagataatagttattatttatggcgcttgttgattgataaggattttcaaaatcgtggatgcggaaaagaagccatccagcaaataattggaaaggcgaaggcggatccgctttgtcataaaatttcgataaattatgtcattggcaatcataaaatgcggtacattttagaaaaaattggttttcaatccgttggtttagaaggccaagaaatgaaaatggaattaattataaaataaaggagttatgatgaaactaaaagaaacactcaatttaggtaagacagcatttcctatgcgtgcaggcttaccaacacgtgagccagaatggcaaaaggcctgggatgaagcaaacttgtatgctcgtcgccaagaactcaatgaaggcaaaccagccttccacctccacgatggccctccatatgctaacggaaatatccacgttggacatgctttaaacaagatttctaaagatattatcgttcgctctaagtcaatgtctggtttccgtgctccatttgtaccgggttgggatacacacggccttcctattgagcaagtcttggcaaaacaaggtgtcaaacgcaaggaaatggacttggttgaataccttgaaatgtgtcgtgactacgcttttagccaggttgacaagcaacgtgatgattttaaacgcttgggtgtttctgcagactgggaaaatccatatatcactttgacaaaagactacgaagcagctcagatccgtgtcttcggtgctatggcagacaagggctatatctaccgcggtgctaagcctgtctactggtcatggtcatctgaatctgcccttgcagaagctgaaatcgaataccatgacattgactcaacatctctgtattatgccaataaggtcaaagatggcaaggggctcttggatacagacagctacatcgttgtctggacaaccactccatttacagtaacggcttctcgcggtttgacaatgggagcagacattgactatgtcttggttcaacctgctggctctgaccgtaagtatgtcttggcagaagccttggttgatagcttggcagccaaattcggttgggaatccttcgaagtgatttcaaaacacaagggtgctgaatttgaatatatcgtgaccgaacacccatgggatagagaagtggatgaattggtcatcttgggtgaccatgttacaacggactcaggtactggtatcgtccatacggctccaggctttggtgaggatgactacaatgtcggtgtcaaatatgacttggaggttgcggtaactgtcaacgaacgtggcttgatgaatgaagctgcgggtcctgattttgaagggcaattctatgacaaggttgtgccaacggttaaggaaaaattgggtgacttgcttcttgctagtgaagtgatcaatcactcctacccatttgactggagaaccaagaagccaatcatctggcgtgcagtgccacagtggtttgcctctgtttctaaattccgtcaggaaatcttggaccaaatcgaagcaacaactttcaatccatcttggggtaaaacgcgtctttacaacatgatccgtgaccgtggtgactgggttatctctcgtcagcgtgcttggggtgtgccgcttccaatcttctatgctgaagatggcacagctattatgaccaaggaagtaacagaccatgtagcagctctctttgaggaacatggttctatcatctggtggaaatctgatgcaaaagatcttttaccagctggtttcactcacccaggttcaccaaatggcgaatttaccaaagaaacagacatcatggacgtatggtttgactctggttcatcttggaatggtgtcatgaatgcccgtgaaaaccttgcctacccagctgatctctaccttgaaggttcagaccaataccgtggttggtttaactcatccttgattacctctgttgctgtaaatggtcatgcgccatataaagctatcttgtcacaaggttttgtccttgatggtaatgggatgaagatgtctaaatctctaggcaataccattctaccaagtgatgttgagaaacaatttggtgcagaaatcttacgtctgtgggtgacatccgttgatacttcaaacgatgtccgtgtgtctatggatattcttggacaggtttctgaaacctaccgtaaaatccgtaatacccttcgcttcttgattgccaacacttcggatttcaatcctgcaagtgatgcggtggcatacgaagagcttcgttctgttgaccagtatctcttggtgaaattcaataaattggtagttcaaatccgtgaagcctacgacaattatgatttcatgggcatctacaaatctgtagtaaactttgtaacccttgatttgtcagccttctacctcgattttgccaaagatgtcgtctacattgatggtgctaaatcactttctcgtcgtcagatgcaaactgtcttctatgacatcttggtgaaaattaccaagctcttgacgccaatcttaccacatacggcagaagaaatctggtcttacttggaacacgaagcagaagaatttgttcagttggcggaaatgccagaggtggaaacctttgctaatgaagcgcagcttttagctgattgggaaaactttatggtcttccgtactcaggcacaaaaagccttggaagaagcacgcaatgccaaagtgattggtaagtcacttgaagctcatttgactgcctatgtctcagctgaaaccaagtccttcttggagagcttgaatgcagaccttgctcagttgctcatcgtttcaaacttgacagtaacaactgaaactgccccatcaacagcgcttgtggttgatgaagttgcctttgctgtagaacgtgcagccggtgaagtatgtgaccgttgccgccgtattgatactagtgttgcagagcgcagctatggcgcaacaatctgtgaccactgtgcaagcgtagtggaagaaaactttgctgaagcagtagctcaaggttttgaagcctaagcaatcacaatacatttgttaaagtctatctagcgataggctttttttgtaatacttttcgaaaatcaaaattattcgttgtcaagagccttgatgaactccagttctatcttcggcttcgtttcctaggctacttttgattttcattgagtataaatagaaaaaaagaagccatctggcttcttacagaacgtagacaaactccaaaaatataaaaaattgaagaggtttgcgaaagatagcaagtgattaaactcttagaaacattgatatttcagcgtttctgagagttttttattttcaacataaagaaaaaagattgaagacaattgtccaaaatggaccttttcttcaatctgaaagaagccagatggcttcttacacttctgcgataatgggaatagacatttcaatcaaacggtctgtgtgaatcgtttgaatggcagccttgttaatagttcgttcatcaattttccgatgaaggaagaaatcacgaatttgctcgatttcattttgttgtactgcacggtatttattactaatcaagagttcataatgacggggtgcctgtgtgaaaataacgtctgtattacctgcagaataagtctctactaggaaagcatcagtattagccaactggctttggacaagattgggatgactatttgtcgtgttaatgattttcatgtggaacctcctctatctctttggctacattatagcacgattagagtgtttttactagttattgaatgaattttcttgcaatttccattgttcaatgccccatttgtgactaccacgtttgagtttatcgatggcttcattgactgggaaccaagcaatatggttgaaatcttctagtggttgtcctatttgatggtagctagttacttcatagatgtaggctggattatagaaatgggtatcgcggtggctagagtagaagtattcgtcagcctgaccaaagtattttccgatttcagcggtgaatccaagctcttccatcaattcgcgctccaaagcaatgaggtgattttctcccttttcaatttctccaccaggaagaaaccaagctccgtttggtgcttgaacgagtatgatctgttctttcttttcatctgggataactgcgtaaacaccaaagcgactctggtagctgacgccagccttcttttctccaaatacagcaattttctccataggcaattctatcctctttcattattggaatgagttgtatacattataccacttttttattatttttccttgtgataggctttacaaagtaaagtttttttataggatggagatggggaagaatttagaaaaatagagtagcaaaacagtaaaataggctactcgtagagagcagctctattttcttattttgtctttgtttgtgccttgatttgaattgtacctttacttgacatgacagcacgtaggtctttttctgctggatgttctaagtagaagtcggtgatagcatcttcaatctgatcttggatggttctgcgtagtggacgagctcccatctttggattgtagccaaggtccactaatttctccttaactttatctgttacatggaggctgatgccattgtgagaaaggcgtttgtttacatcgtctagcatgaggctgacgatttcaagtaggttttccttgctcagtggttggaactcaataataccgtcaaatcggttcataaattcaggtgtgaagaaattgctaagttggccaaggactgattgagtccgcccttccatagccgcaccaaaaccgacacttgcttcaacttttccagtaccagcatttgatgtcatgatgataatggtatctttgaagctgactgtccgaccttgtccatctgtcagacgcccatcatctaagacctgaaggaacatgtgcatgacatctgggtgggctttttcaacttcgtcaaggaggatgagtgagtaaggattacgacgaactttttcagtcaattgtccagcctcctcatagcctacatagcctggaggagctccgacgagtttagcgacagcgtgtttttccatgtattcggacatgtcgaagcggatcatgctgtcagccgaaccgaagagttcgatagctaattgcttagacaattcggttttaccgacacctgttggtccgacaaagaggaaggaaccaatgggacgatttggagcaccgagaccgacacgattacggcggatggctttagctatcttgtcaactgcttcatcttgtccgataacatgggcttttaagtcactagcgaggctcacaagctgggactgttccttttcttttaaatcaccaactgggatatttgttttttgctcaacgatggcttcaatttctttttcagtaatgagtggaatatcttcttcgctgatagttgccttttgcatctccttgtacttagcaatttggtcacggaaataggctgctttttcatagtcctcatcccgtgtagcttgtgctttacgattttcggaatcaatcaggcgttggtcaatttcctttggatcaataaagttgagggtcaaattcatttttgaaccagcttcatccagaaggtcaatagccttgtctggtaggaaacggtcttgaatgtagcgattggacagtactgcggcagcttcgatagcagcatcggagtatttaacatgatggtaatcctggtatttattttggatacctttgaggatggtaatggtttcttcgacacttggttcttcaacttttacaggttgcatacggcgttctagggcggcatctttttcgataatacggtactcgttgagcgttgttgcaccgactagttgcatttcaccacgtgcgagggctggtttgaggatattgcctgcatccatgttaccatcgcctgcagagccagcaccgacaatttcgtgaatctcgtcaataaaaagaatgatttcgcgacgattacggatttcttccatgagtttttgcatgcgttcttcaaattgtccacggatacctgttccttgtacgaggctgacaacatccagacgaatgacttccttgtctcgtaatttttgtgggacatcgccatcgacaattttttgagccaagccttcaacaaccgctgttttacctaccccaggctcaccgataagaacaggattgttttttgtacgacggttgagaatttcgatgacacgggtaatttcttgatcgcgaccgattactggatcaatatccccacgacgggcaatttcggtaacgttgataccaaattcttcaaggagcccatttggttgttggggttgttgcggaggaggggtctgtccaccacgtccattatgcccaccggcttgagtgggaggagtctgttcgcgattttttccagcaggggtattgccaggatagccacctaggtgattgaaaaattcactaaagggatccatattgttaggatttgttaaatctcccaacccacgtaggatagcattatgagggtctgttttcatgatttggtagcagttgtgacagaggtctacctgctgctgtttaccgtttaagttggtgtagagatggatcgttgcgtcgttgatattacaatttttgcagagcataattctacctctttctgtgaaaaaatgtgacctattgttaaatagtcaaaaaaggtcagttctagctttattataacaagattcatagaaaaatcaagaaactgctacgcttggaaaaactttctatgaaaaatagggcgataggaagaaaatagggaaaaaataagacttttttggtaatatgtggtaaaatattcctataaaaaggattaggagaacgaatatggaatcacatttggtgagaattatcaatcgtctggaggctatggctaatgacggcggtacgttgaaacgtaatttcgaacgtgatggtattgttgttgcagaagtggcttatagctatgacgaggaaaatggttcagtatttaccttgcgtgatgttgctgctcgtgaaacgtacgcgtttgacagcatcgacttgattgcaatggaaatctatgagctattgtactaagaagaagtgagaggcacctaagggtgcttttttcttgtgtaaattgaatattataaacaaaagtattgcataaatattcaaaaatggtataatagactctaaatgacagaattggagtaagatgaatgaatttttcttttttgcctgagtattgggcttattttaattatggggcaattgttaccctcattattgcatttttctcagtattttttggtagtattttaggtgtgttgcttgcctttgctcagcgtagtaagtataaagttttagcttggactgccaatatctatgtctggattttccgtgggacaccgatgattgtccagattatgattgcttttgcgatgacacattttgtagcaccaacttttcagctaggaattttgacggttgatttgacgcgcttgattccaggtatcattgttatttcgatgaactcgggtgcctatgtatctgaaactgttcgtgcaggtattaatgctgtaccaaaaggacagctggaagcagcttattcgcttggtattagaccaaagcaggcgatgcgttacgttatcatgccacaggctatcaagaatattcttccagccttgggaaatgaatttgtgactattgttaaggatagttcacttttgtcaaccatcggtgtgatggaattatggaacggtgctcagacagttcaatccacttcttatattcctttaacaccacttgtatttgcagcgagctattatctaattatgacaacggtgctaacagtgattattcagtcgtttgagaaaaagttgaacaagggagggcagttccatgtctaatgcgattatttctatcaaggatttacataagtacttcggaaagaatgaggttctaaaaggaattgatttagatattcaacaaggtcaggtggtcgttattatcggtccatcagggtcagggaaatcgactttcttacgtacaatgaacctcttagaagtgccaaccaagggaactgttacatttgaaggtgttgatattactgacaagtcaaatgatattttcaagatgcgtgaaaagatgggaatggtttttcaacagttcaatctttttccgaatatgacggtattagataacattactttatcacctattaagacaaagggaattgcaaaggatgaggctgagaagaaggctaaggaattacttgaaaaggtaggattgccagataaggcaaatgcctatccacaaagtctttcaggtggtcagcaacaacggatcgctattgcacgtggtctggccatggacccagatgtcctactttttgatgaaccgacctctgcactagaccctgaaatggttggtgaagttcttgctgtaatgcaggatttggccaagtcagggatgaccatggttatcgtgactcatgagatgggatttgcgcgtgaggtagctgacagggttatctttatggatggcggtgtcatcgtggaggatggaacgcctgaagaagtctttgaacataccaaggaagaacggaccaaggatttcttgtctaaggtcttgtaataaatgaacaaataagtacgactccgatattgttcggagttttttgctatatgctatattctactttgtacaagtatagtcagtcggagaattttagggtataatagaaaaaacaaaaggagtgtaggtatgacagtcattgatgggaaagcactaggtgtaaaattgcaggctgctttggcggagaaaactgctcgattaaaagaagaaaaggggttggtaccaggtcttgtagttattttagttggcgaaaatcctgctagtcaggtttatgtacggaataaggagcggtcagctctagctgctggattcaagagtgaggttgttcgcgttccagatacgatttctgagtcagacttgttggatttgattgagcgctataatcaggatgatgaatggcatggtattttggtgcaattgcccttaccagcccacatcagcgaggagaaggtcttgttggccattgacccagataaggatgtggatggttttcatccgactaacatggggaaattctggtcaggtcatcctgttatgattccatctaccccagcaggaattatggaaatgttcaaagaatatcagattgagctggaagggaagtctgctttagttattggtcgttctaatattgttggtaaaccgatggcacagctgttattggatgccgatgctactgtaacgattgcgcattctcgcaccaaaaacttgccagatcttgctcgtcaggccgatattcttgttgttgccattggtcgtggtcattttgtgaccaaggaatttgttaagctaggtgccgtggtgattgatgttggtatgaatcgtgatgaaaatggcaagctaatcggtgatgtcaaatacgatgaggtatcagaagtggcaagttatattaccccggttccaggtggtgttggtccgatgactattaccatgttgatggaacagacctatgaagcttgtgtcagaagtgcaaaataagatagagagtttaataaaaataaatatatccatgcctgctttggtaaagccctgttcttagaacctgtatttacaagcgaagtactcatattaagagacagatttagctaatcaaggtaatttttttgggggatattgattgtattttgaaaaaaactaatgatgagtagcttaaaaactagccttagaatagaagcgttgaactgtgaatacaggttcttaaattatgcttgtagttttggtagctaacagtaatgagtgcagtccccgtatgaataagtctatttttaaacgactctacttattttattagtcatattcaataaatcagttttaagacggatgtgacttttagtaatattggttatactatacccaatcctaaatatttttcataatctcctgaaaagcctgatcgtgtgatcaggtttttttgtatgcaaaaatggatctgtacaaaaaaacagtactatttctcaaagtttgaacaacatcccagtgtagtaaaaacgtttggagacagattgtttcagctcaacaactgggaataaagatttattgccgaactcttttatactcttcgaaaatcaaaatcagacgttgttgacttgatttgatgaacttcagttctatctgcatctgcgtcgcctagtctgattttcattgagtattatctgtttagttctttctctctttcattttgtgtttataatgttttaggtgattgtgggacgttttcagtgaaactgctaatggaacggttttactcctagccttatctgagtaataataggataaaactcatatacccacataagagtgatagaggtttgtgaatagtatttagttagaaacatttgttatcaaatacaggttctacgttatatttaaagaacttctctatcattcgttaaatatttcttctccgatttatcgctagataggagcagtgtatgcgtttctaaaaatctaaagttggaggatgttcaattttaaataagttacaatctgcaaatcactactaaaatcaatttatcccttatacagggtaatgtaataaattgttttttctttgtttttcgtatgttttttcaaaaaaatatatgaaacaaatgaggggaatctagtgatgcactagctatgaaaaaaatatttatattaatggaattgtttgagaaatcagaaggatgtagtttttcgatttgcatacatattttaacttaaacatatgtgtgcaaaaagttctgatttttttgtgttttttaagaaattggcattgttgacaaactaaggattggtttggtatcacgtacaggctaatttgatcatattatattcacaaaaatgtatatgttttgattgataggtgatatgttagaagtaaataagcatatattttgtagtgaaagcaatataagcaaaaaggagagaggaagaagcaatgttaaatgcaaaagaccttagaaaaactgaagcgttctgaattatttgaactcttggttgagcaggcaaaggaaatagagtcttatcaagcaaaattagtagatttggaaaaaagaattgagtatcgcgaagcggttttgggagaaattggttcgatagcggaggcgtctctagcagttactaggatttttgaagaagcacaattggctgcaaatatttatcttgaacaagttcaaaaagttacacataaacaatctgataattgtgaaatagggagaacagatgaggatggcgactaataaaaataaggattatgttaccatatcagatttacccagtatatcaataatgtcagaggagctggataaaatacgatataaagagcggtatttagagacattaaaaaatactattttcacgcttgttactgtcgttgcacttgcagtattaatagccatgttatggttgccagttctacatatttatgtaagttccatgtctcctactctgaaagcaggtgatatggtagcaactgtgaagacaaatacactttcaactggagatatggttgcattctactacaataataaggttttggtaaaaagagtagtagcaacttctggtcagtgggtaaatatagatgagcaggggaatgtttatgcaaatggaaaaacattagacgaaccctatgttaaagataaggcctatggtcaaactgatattaaactaccgtaccaggttccagaaggtcaatattttgtaatgggagatcatcgcagtgtatctattgattctagaaatacagctattgggtcgattggtgaggagcaactggttggaaagttaacctttcggatatggccatttcataaaatgggagtaatcaaataaaggaaggagatataaaacatgaaaatattatgggaaagattgtttaaatttgttcagcaatactttcgagagaaaaagactgcaaaaataactatggtgttgtcaataattatggcttttggaatatcatatttgctgattttaccagccattactttagagacagacagtcaggagagtgttctgcaatcagtctataatcagccaacaacagtagaacagccagttcaagaagaacaggcggagtcacaattggcacaggttcaatctgctggaagcttattcgctgaacatgaaaatataactgtacaagttaactatgaggagcatacatttgaacagccagttcggttacaggttttaccctcagaagatagtacaaaatatattggacttgttcggtaactacatcatctcatggttgatgataccacaaatcaactcagttcttaattcaaaccgttttctacgattacgatagggctgtgccatgattttaaaggttttaaatttggcattaaagtgttcaacttcaatacggattttagctatctctcgattcaaccgtctatcctcttcggttaagaggtgatgtttagaatgcttagcaggaataaaggtattttcgtgaaatttcaagatgcctaaataccctaaatctacgaaagcaagggtattttggggcaaactatagccaatactctccttaaaaagggtaaaatcatgcgtatgaccatctgaaaaagccaattgacaagcacgatggctagtcaaatcaggcatgatttgagtctgctagtctttttcttaataactggcctattattgttattatatccaacagtaagtgattattggaactcacattatcaatcagaagcagtagctacttattctgagaaattattggatatttcaaaagaagaaaaacaaaaaattttagaaaatgtcagtgcatataacaacacgctcgaaaaggggacaatacctaatttaaatatagacagtgtagctttaaaaaagtatgactcaattttaaatatcacagatactggtattatgggctatgtagaaattcctaagttgcagacaacgttacctatttatcacggaacggatgatgccgtattgcaggtagcagtaggtcaccttgctgggacttcccttcccattggcggtcagggaagtcacgctgctatttcaggacatcggggattgccttctgcaaaactgttttctgatttagatcagctggttataggggacacatttatgatacaagttttagataacactctgacatacgaaattgataaaattattacggttactccagatgatgtatctcctttgatgatagatccgaatgaggatttcgtaacccttgtgacttgcacaccttatggtgttaatagccaccgattattagttagaggtcatcgaattgaaaatcaactacttgctaggcaagtagtctcagaaggatcaattgtaaaacctatactggtttctccttttattgctttatgtttattaggactactttggagtttattttttataaaaaaagaagtaaatttgtttatgtgacttagataatatcgcaaagaatgtcaaaccattcgactttgttctttagcttttaagcttaggaaagggaggtttttcaactcccaatcatccaaaaggtgaaatagaagataaaccaaatgacgatatgtcaatgtcctctatacgccagaaaaaggtggcaagcgagcggtcggctacggcattgaaattcccaaagaatttgaaggcaaattcaagtttgcccgccaacgctccaaactagctggggaaatccgtggcactttcttcgttgtcaagggtaactatttataggggagaaaatctggggaaactcagattttttgtcgcatacttgacttcaaggtatataatagatatacaaaacgaagggagaatgaatatgaacattaaagaagttagtgatgtaacaggtctatcggcagataccattcgctactatgagcgggtagggcttattcccaaaattgcaagaaaatcttctggagtaagggactttgtggaaaatgatgtagccgttttggaatttgttcgctgttttaggagtgctggtatgtctattgagcgcttgattgagtatatgggcttggtgcaggctggcgatagtactgtggaagcccggattgatttactaaaagaggaacgggaagtcctgcagtcacgcttgtcgaaaattcagcaagctctagaacgtttagattataagatagaaaattaccagactatattaagaggtgcagaaaatcaattgtttacagacggcagtggttcatgcaaaaaagacagagaataactttctctgtcttcatacttcattattaattttttctgataacttgtttgggtttaaatttcttctttagtccaatttgaaccaaacgtagtccaagaaaacccgtcgcacttgccaatatgatggcaataaaaacaggaatgcctacagatagatagacataactagcgatgactgttatcaaactaaaaaatgcgatattaacaaaaaacaacaattcctttagacgttctttattggcattttttgcttgataggtttgaaaattagcctttttctctttcgggatatactcttcgtactggtactcatgggactgatagtgtcttaatggcatatcgtctccttttctgctctttaaagaataccatatcattgatgaattattatgtcatttatattacaataatgttacaagaaggatattagaaaagtctgaatattaaaacacggctagtcacttatcagatatttctctttttgatataattatccttatggaaaaaattatcattacagcaacagctgaaagtattgagcaggtcaaagaactgcttgtagcaggcgttgaccgcatttatgtaggtgaagctgaccatgctcttcgcatcccaacaaattttacctatgatgaactcagggaaatagcagagctagttcatagcgctgggaaggaattgacggtcgctgccaatgccctcatgcatcaagatatgatggacaatatcaaaccgtttatggagctaatgagggaaatcaaggttgattatctggttgtcggagatactggaattttctatatcaataaacgtgatggctacaatttcaagctaatctatgatacatctgtctttgtgacttccagtcgtcagattaacttttggaaagatcatggagcagtagaggctgttttggcaagagagattccatcagaagaactctttgatattgctaagaacttggaaatgccagcggaaatcttggtctacggcgcctctgttattcaccattctaaacgaaccttgttacagaattactacaattttacaaaagctgatgagacagatttgtcacgtggacgcggacttttcttagctgagccgagtgacccagatagccactattccatttttgaagataagcatggcacccatatctttatcaacaatgacattgatatgatgaccaagctgtcagaattagatgaacatggttatcataattggaaacttgatggtatttattgccctggtcagaactttgtggaaattgttaagctttttgttcaagcaagagatttgattgaaaaaggcgacttcacttatgatcaggccttccttttggatgaacaggtacgtaagctccatccagctgaacgtggcttggatacaggcttctacgaatttgaccgcaataaggttaaataataatatttatagcagaatttatttactttaacctgacagagttagctctgtcacttacaatgtaaggtcagagcacgaaaacgcctttgggcgattttctaatctctgccctaggtttccgagtgaaacaacatcgtttacagtattctatcctggcagagttagctctgtcacttacaatgtaaggtcagagcacgaaaacgcctttgagcgattttctaaactctgcactaggtttccacatggaaaagtatcgtttcatgtggaaaccgtcgcaaatagaggagattttacatgatgtcaaaaacattaaagcgtcccgaggtcttgtcacctgctgggactttggagaaattgaaggttgccattgattatggtgctgatgcggtctttgttggcggccaggcctacggtctgcgtagccgagctggtaactttaccatggacgagatgcgggaagggattgaatatgcccatgcccgtggtgccaaggtctatgtagctgccaacatggtcacccacgaaggtaatgaagaaggagcaggagcctggttccgcgaattgcgtgacatgggcttggatgccgttatcgtatctgacccggctctcatcgttatctgtgcaaccgaagcgccaggccttgaaatccacctgtcaacccaggcttcttccaccaactacgaaacctttgagttttggaaggaattgggcttgactcgtgtcgtcctggcccgcgaagtgactatggaagaggtggctgaaatccgtaaacggacagacgttgaaatcgaagcctttgtccacggtgccatgtgtatctcctactcaggtcgttgcgttctctccaaccacatgagcaaacgcgatgccaaccgcggcggttgctcccaatcttgccgttggaagtacaacctctacgacctacctttcggcgaagaacgccgttcgattaagggggaaataccagaggagttctctatgtctgcagtggacatgtgtatgatcgaccatattccagatatgattgaaaacggggtcgatagcctgaaaatcgaaggccgtatgaaatctgttcactacgtatcaacagtgaccaactgctacaaggctgcggtagatgcctatcttgaaagcccagaaaggtttgaagcgatcaagcaagacctgattgatgagatgtggaaggttgcccaacgtgaattggcaacaggattctactatagcccgccgagtgaaaatgagcaactctttggagcccgccgcaaaattccagaatacaaattcatcgccgaagtagtggcttttgacaaggaaaccatgactgcaaccattcgtcagcgtaatgttatcaatgaaggtgaccaagtagaattttacggaccaggtttccgtcattttgaaacgactattcaggacttgcatgattcaaatggagaaaagattgaccgcgccaacaagccgatggaactcttaactattaagctggaccgtgaaatctatcctggtgacatgattcgtgcctgcaaatcaggcctcatcaacctctaccaagaagatgggcaatctctaactattcgtgcataaacatatagacatttagtttttcttttattacttcgacgtaagaggaaactccgtttccttatttccaacttcaaacactccactggattgtttgaactcgctttgccgtactctgcaggggtgacttgctccgcaagtgctatctccaacctccaaaggttccccaaacctttggagcgagtactaaaagtaaactaaaagactataaaaaggctgaaatttcagcctcagaacgtagataaactcttaaaaatataaaaaaatgaagaagtttgcgaaagatagcaagtcattaaactcttagaaacattgatatttcggcgtttctgagagtttttaattttcaacataaagaaaaaagattgaagaaaattgtccaaaatggactttttcttcaatctgcaaggctgaaatttcagccttttgtttgttgttgagaagtcttgatgctatctggaaccaaggtgacttttttgatgtcctcgatttttataatgctggtaacctgacgtttgaaatttttcatgataatccgttggcgatcggtatcatatttcacaatgtcacctgtgaaactacgatcaccatagatgacatggactgcagcttttttatataaagccagctccaagttattcttgatttcttccttgctatctggctcaatagacttaggagctttgccatgttctaaaaagatggtgaactgctcgaaaataacttctaaaaacctcttcatggcgtaatcctttcaaacttgatataattatattatctaatttttataaaaatgacaagctttttcgaatagataagtgaggaggtaacaaatggcagaatttacatttgaaattgaagaaaaattattggtcttatctgaaaatgataaaggatggaccaaggagcttaatcgagtatcttttaatggcgcaccagccaagtatgacatccgtacctggagtcctgaccataccaagatggggaaagggatcactcttagtaatgaggaatttcaagttctactcgacgcgtttgctaataaataaatgaaggaagcctaagcaaaataggcttcttttttgataacaggttgcaataaacgatgacaaatcatgactagtgtaattttagctaaatcaggaagaatgaaaggcagaacagtccagccgatagtgtcagtccaactggcacctgaaactagtttaaatacacaacagccgagaaggaaacagatacttgttccaagtaggcaggctagaaaaattgtaactggtgaggagtctgatttagtgagggcagaagtgatgatagtgtagagtagaaacccccatagaaagccagatgtcggtcctgtgagtgcagcaaagccaccagaaaaaccagcaaaaacaggtaaaccgatagcgccaagaactagatataagctgacacttgtaattgcctccttgggtttgtatagacaagctactaagccgatagctaaggtttgtaatgtaaatggtacaggtccgatagacagactgatttgtgaaagggtggaaattaaggctgttccaatagcgatataaacaagtgatttgatagaagttgttttcatttgttatcctcttaaaattttatggttaacaaaaattatagtgagattggataagaaagtcaatgctctttcatcggctgtaacaactctataggtgatttttataacagctaataagaaacttatatagttaaaagcaataaattatatgtaaaacaacctatacctatgctagaataataaaaaaagaaagtgagaatttctatgacagaattacttgatatttaccgtactcttaaatctaaaacttgggtagacttgactcaccaaatcaatgaaaagagcccgcatttccctgcgctaccagctctcgaaaagaaagccctatttactcataaggatggcttctttgtcgaacaatttacggttgtggggcagtacggaacccatattgatcctccgattcattttgtagaaggggctcgttatcttgatgagattgatttgaaagatttactcctgccactctacgttattgataaatcagctgctgttatagaaaataatgactatgagataactaagcaggatattttagactttgaggctgaatatggtccgatagcgccaaaatcttttgttgcctttcgttcggatttgtcaaagcgctggcctagtcaagatgccattcgtaatctagacgaagatggagttcaacgtacaccaggatggagtcatgaagctctagaatatttgattgaagaacgtcaggtgaaagcagttggtcatgaaacattggataccgattcaggagtatctgcagccaaacacggaggaagtttatcagaagaatactatctcctatcaaaagatatttatcagttggaagtattggcaaacttggatcaggtaccgccaacaggtgcattgatttcaatcgcttttcctcattgggagaaggcttcgggttcaccagtgcgagcaattgccatattaccataaaaaaagtccagacagtgctgaccttcatgtctggactttttcaattgagttaacgcatagtaacaaattcttcagaacctgtcggatggatggcgacaacggcatcaaattcttcttttgtagctcccattttgatagcaactgagaatccttgaatcatttcatcgacaccatagccaatgccgtgcagtccaacgactttttcattttctcccacagttactaatttaaacttagccatttggcgattgttttctagggcagtgtacatagaagtaaaggctgaagtatagacttttacattgtcctgaccgtattgggtaatcgcttcgtcctcagttagaccaacggttccgatagcggggtgagaaaagacgacagttgggatggttgtgtaatccatttttgcggttggtttattgttaaataaacgttctgccaaaaggcgacctgccttgattgcaacgggtgttaattctttttcaccagttacatcaccgagggcatagatgcctggtacagctgtttcttggtattcattgacagaaatatgtcctgaagaagtaagttgaacactagttgctttcaggttgagtttgtcaatatttggtttacgtccaattgcccaaaggaccttctgagcaatatggttactaccgtcagcaaagttaatctggatttgtccatcatcagttttttcaagactgacaggagttttcccggtatggagtggaaggttggtacgttgcatttcttccatcaaggcatcaacaatgtaggtatcaaagctacgaagagggcgattaccacgaacaaataggtcagtttggacaccgagtccatgtaggagaccggccatttccacagcgatataaccagcaccaatcacagccacagaagagggtaattcttcccatgcaaagacatcgtcagatacaatccctagctcactaccaggaatagcagggactaccggtttggcgccagttgtgatgacaatgtgttttgcacgaatcagttcaccattgacttcaaccgtttgattatccacaaaacgtgcgaaaccctggataacttctacttcgttattgttaaaagtattaccgtaggatgcgcgtgaacgctcaatataggcttcgcgatttttacgcaaggtggcaaaatcaaaggtcacttcttggctagtaaatccatattcaggtccataatgctgaatggcttctgctacctgagagccgtaccacataatttttttgggtacacagccaaggttaacacaagtccctcctagatagcttccctcaataactgctgccttggcaccgtacatagcagctcggttcatggtagcgatgcctccgctcccaccaccgatagcgataatatcaaacactttcataaatttcctccaataaaggtcaataattatattcattgtaacgcttttttgtatgtcaatcaaaaatctgctacgtcaccttacaaaaatgtaagtgggaaaattgccgaactttttataaaatagttaggaaaaaacttgcatttgttcttgtatttgtgtattatatagacaacacaaataggtatgttttgtaaagaaaaggagtttgttatgttaaaaacaaagaaagcaaaaattgctttgtttggtggtcttggagtggtcgcagttgccttagtaggtggggctttgatttttagcaatatgctaacatcaccatcatcttcagaagatgtagccatgagtatgacctatactgttgctaaagaaggctcaattgcttcctcaacgctacttacaggaacgattacagcagcagacgagcagtatgtttactatgatccttctaagggagatttgagtgaggttttggttgctccaggtgctaaggtcgaagtaggtacccctttgattcgctatgatgctacagaattacagtctgctttggatactgctgttcgtggtcgtgataagattggtcgccaaattgcagacttaagaaccaacggtcagactgttcaaacaactggtgatgcagaaacagatgctgcagcaactgctactgcacaacgttcagtagatatgcagttggcagacttgaatgattcatacgcagatgctcaagctgcggttgataaagcatatacagccttaacagaagcgacagtaactagtaccgttgctggtacagttgttgaggtgaataaggctgtttctaagaattctacatcgagccaaacagttgtacacattgtaaatcaaggtagtttgcaagtaacaggtagtttgacagaatacgatttggctaacattgcagtggatcaagaggtcaagctgactagcaaggtatatcccgataagacttggacggggaaaattacctatatttcaaactatccatctagtaatcaagctggtgctgctacaacaggaaccagtggttcaggtgccaaatatccatttaaggcagctttaactagtgaattaggtgagttgaaacaaggattttctgtaaatattgaggttgtcaatacaagtaaaaacattttaattccggtgtccgcagttgtgccagaagaagataaaaactatgtgtggaccttggttgatgggaaagctaagaaagtagaagttactctggggaacgcagatgctttgaaccaggaagtgaccgctggtatagcagcaggagataaggttattaccattccaactccgaatctcgaagatggcaaagaggttgaagccaatgaagaaccagcttattagactaacaagtatcaataaatcctacaaaaatggtgatcaagaactccgagttttaaagaatattgatttagaggtggaagagggagaatttcttgccattatggggccctctggttcagggaaatcaaccttgatgaacattattgggcttttggatcgtttcagttcaggaaactattggctggaaggtgaagaagtcagtcaactttctgagaaaaaattagctcaggttcggaatgaccaaatcggtttcgtctttcaacaatttttcctcttatcgaaacttaacgcccttcaaaatgtagaattacccttgatttatgctggagttccatcaagcaaacgtaaggaactagcaaaacagtatcttgaaaaagttgagttggcagagcggatgacgcatttaccatcagaattgtctggtggtcaaaaacaacgggtagctattgctcgtgcactagtcaataccccagctattattttagcggatgaacctacaggggctctagataccaagacaggtgagcagattatgcaacttctgacggagttgaataatgaaggaaagaccattatcatggttacgcatgagcctgagattgctgcctacgcaaaacgaaaaatcgttctacgtgatggagtgatcactgaagatagtcgaagggagggagtttagatggaaaattggaaattcgccctcaaatctattatggctcataaaatgagatcgctccttactatgttaggtatcatcattggtgtggctgcagttgtcattattgtcgccatgggaacaggggtggccaaaagcatagaaaagtctctagctggtgatcaaaataatgttcaggtttactttactgctttctccagttcaggtacagctttcggtccgtttggcacagcgtcgacagaagaaccaattttagaggaagagccggatttgacggattctactttaaaaggactgctagagattgatggcgtatcaaactattactccagcatcagcaacatagctgaagtcagatcgggcaataaaaaagcagagaatgtcactattactggtgttagccagaatttctttgctgtgaaagagtatgagattttagctggtcgtcagtttacagctaacgactatagtcgtttttcacgtatgattatgttagatacggcattagcagagaagttatttggttctatagagaactctctcaatcagacgattagtgttaatagcaatgcctatctagtaataggggtctacaaagatccgaaagcaggcacagctatttatggaatgaattcaggtggaaatgccgtcatgactaatacgcagctagctgctgaaacaggcatgaaagaaaattctcaaatctttgtccatgttgaagatgttactcgggcaacagaagttgggaaggctgctgcagattacctgactaaagcgactggattgaaagaagcgagatacgagatttatgatatgtcagctatgttggaggagtttaaatctcaaatgtctggcgttacattgtttatcggtgctgttgcaggtatctccttgctagttggtggtatcggtgtcatgaatatcatgctggtatcagtaactgagcggactcgtgaaatcggtcttcgaaaagcgcttggagcaactagaggaaatatcttgattcaattcttgatagaagccatggtcttgaccactcttggtggagcaattggtctcgcaatcgctcagacaatagttttcttgctcaatgtgagcaaggcgttgggcgaaagaatagctgctgaaatttcaattcctgttgtgttaggtagtctggctttctcagcagtagttggtattgtatttggcgtactacctgccaacaaagcatctaagcttgatccaattgaagctttgcgctatgaataatctattgaaacgattaggttttcctagtcgttttattttttgagcaaattaattgaatttatcactaattagcgataaaataaacgcatcaattaagaaatagtgatttcaaaggagaacacatcatggtagaattaggtatttcaacatttggcgaaacaactccactagaaaaaacaggggaaacttacagccacgacgagcggattcgccagctagtcaaagaaatcgaactagctgatgcggtgggacttgatgtttatgggattggggagcatcaccgagaagattttgcggtttctgcacctgagattgtgctggcagctggtgccgtcaataccaagcatatcaagctaacatcagcagtttcaatcctttcctccatggatcctgtaaggctctatcagcagtacaccaccattgatgctttgtcaaatggcagagcggaaatcatggcgggtcgtggttcctttacggagtcattccccttgtttggctatgatctccacgactatgaagaactcttcgatgaaaagctagatatgcttctggaaatcggcaaggaaaccaatctcaagtgggatgggcattttacccagtcagtcgataataagccagtctatccacgtcctgttcaggaagattttccgatctgggttgcaactgggggcaatgtagagtccaccatcaagattgctaagaaaggcctgccaatcgtgtatgcagtcattggtgcaggtgcccatcgctttaaacctttagtcgatgcttatcgcaaggttgctcgcaactcaggtcatgatccaaagaaaacgaaagttgcagcccattcttggggttggattgcagacgaccatgacaaggctgtggaagaatactatcatccaactaaagtaattacggacaatattgccaaagaccgcccacattggagcgagatgaccaaggcgcaatatctctactctctgacagacgaaggagcaaccatcgtcggagatccaaaacgagttgctgaaaaaattatcaagactattgaaacacttgacttggaccgtttcttcctccatctcccaatcggctcaatgccacatgaagatgtcctccgtgctatcgaactctacggaaaagaagttgtgccaattgtccgagattattttgcaaaaaaagaagagaatcagtcccaggactgatgagataaaaaggatgggacgttataatagcctcacttctctaaagtggagtcaacatctcagcgcagtggttgattggaagatttgttcgtgttttacactccacatcttcctctacggctgaagcgaacggtgttcgctttatttccgacctccaacagtcactattctgactgttctgtagcgaactctgttcgctctatctccgacctccaaaggttccccaaacctttggagctgtgcgggggtgggagtgaaacagtctggggatagactgtttcagctcaacaactggaaatatgaacttgttgacgaactctctatgattatttgagttctttcccactcccaatcctaaatatttttcataatctcctgaaaaacctgaccatgtggttgggatttttgaatgcaaaaacactcttggaatttccaagagtgttttacgtaacggtgttaaacagtttgtaatttttatttcatcgtcgggagtgagaaggtctggtagaccttttcagccaatcgccaagaaactggagagcgatttgaacatcctagtgaaaacaaacctagcaagctactcttgcttacttcatagtagggaatagcaacacatcccgaatagtagttgtatctgtcaagagcatgcagaggcggtcgataccgattccaagtccacctgttggtggcataccgtattcgagggcttcgatgtagtcgtagtcaacgcctgtcgcttcgtcgtcaccgagttctttagccttggcttgggcttcaaagcgttccaattggtcgattgggtcgttcaattctgtaaaggcatttccgtattccttggtcatgatgaagagctcgaagcgatctgtgaagcgtgggtcttcatcgtttttcttagccagtggagatacggctactgggtgaccatagacaaaggttggttggataagagttgcttcaacgtattcttcaaagaagctgttgatgatttgaccaacttctgtatggtgtttttccacagggaccttgtgctcagctgcaagggcttttgcttcctcgaagctcatctcttgccagaagtccacgccagtttgttccttaatagcgtcaaccatgtggatacgcttgaatggctcgtggatagcaatttcagtgccctgataagtcaccggaccatcaccgacaacagccttggcagtgtgctggataataccttcggtcaagtccatgatgtcttggtagtctgcataagcttggtaaacctcaatggaagtgaactcagggttgtgggtcgcatccataccttcgttacggaagatgcggccgatttcataaacgcgttccataccgccgacaatcaggcgtttgaggtggagttctgtcgcgatacgaaggaccatgtcaatgttttgggcattgtggtgggtgatgaatggacgagctgcagcaccaccagcttcgttgtgaagaactggtgtttccacttccaagaaaccaagtccgtcaaggtaacggcggatttctgagataatttttgagcgggtcacaaagcgatcaaagctctcgcggttagtaatcaagtccaaataacgtttgcggtagcgggtctcgatgtctgtcaaaccgtggaatttttctggcaatgggcggagcgctttagacaagtgagtcaacttgcgagcatggatagacaactcaccaacgtttgtcttgaagacatctccctcgacaccgataaagtcacctaggtctgcttttttgaagatttcatagttttcttcgctaacatcatccttacgaacgtagatctgaatctggccttcgcggtcttgaatgtgagcaaaacctgccttacccttaccacgcttggtcataatacgacctgcaatgattgctgtttgccctaattcttccaagtcttcttttgatttgtcttcgtactgggccttcaattcagctgagttggcagaacgctcaaaacgttttccaaatgggtcaatgccttgttcagcaagagccgtcattttctcacgacggacaatctgttggtcatttaattcttcaaaatgttcagttgacataaaaattttattcctccaaagtctgttatttctattttatcatagaagagagaaaaaatcagtataaattgctaataggataggaaaaaacagcagaaaattctactgttttgctttatagctggtatcattccaagctaattctgtaaagttttcgaaatcgcttgtttctaaaatagtaaccgatgcattatccaaaccacctcggtgacgcagttgggctggtggaaaaccaagtaggcgatggatagaagcggttagaaaagcaccatggctgacgatgaggactgtttccatgtcttgccctttcagcgattggacaaagtccaccattcgttgagttacctggcgaacgctctcagcttcaaataagtcattgttaaaaagtgctagattatgtttgagtgcccaggcttgtttgggatagatggcacgaaaaattgccatcttgcttccttccagcgttccaaaattccattcacgtaattgttgcgtggttagaacggtttggcaatggtgattggctttggcaatttctacggcagtgctatgtgcgcgctgcaaatcactagaataaatagcatcaaaggggatttcagcaaggtatttgcctagtttttctaaatcctgataagattcaggcaagagagctgaatctccagaatagccttgaaagcgtccctccaaattccattcggtcttaccgtgacggacaaagtagattttcaagtctagtccctcccctcgatcaaatcggcaaagtcagcttttacaaaatcagctaatacctgactgtcaattcgaatcgaccgaccaatttctccagcagagacaatcaagtgaccgagttcaagggcagattgatcaatgtagattgggaaattatgcttctgacgaatgcctacgggattgttggcaccatggatgtagccagttgtcttttccaagtccttttgcggaatcatactcacttttttattgccagagatcttggctaattttttctcagacaggtgttctgtgattgggataatgccgataattggtccagttttatctccagttaatgccagtgttttgtaaatttcgtgttcttcaattcctggtggaagttgaccttcgaaggcatttaaaacaaggctatcatgattgatcttagccttgtccaatatttggtccaccaaggttttctttattttaaccttttttgccattatttatatttttcctcaagtttactcatccaaagccctaaccatgctcctagtataaataggacaatagcagcaatccatgtaacaaagttagcgccagcataggaaatagactctttattacttgcttgtggaatcaaaattaggagagtagaagatgaaacgataccaataataaagtgataaacacgtgaatggtatactttcagagcgtggtccattgcttttgaaaatgcaaccattgcaagaacgccaccgattgcgattggtaggaaggtaccgaatagatcaagtgatttgaaaccatttagcattggcgtgtagatacccaaaatcaatagtaagtttgaagggctgagtccaggaacaagtacccctaaagcaatcaaggcacctgccaatacaaaactagcaaaagtagctggaagtgtcccgacaagatcgctcaaattgtaaagtaggaggccagaaataatgaatgtcccaatcaaccaagccaaatcaatgctatctcgtttgctcttttgagttgattctttaagtaggctaggaatcgttcccacgattgctcccgcaaaggcccacaaaactgggacttggaaatgttgcaataaaaattctacagggaaagagaaaagtgcgattcccaaaattccaccaattcctacaggaacaaaataaagaaagttttccttgaaatcttttcgaatatttgctaaaaatccaattagtcgctcatagattccgaggatagcagcgagtacccccccagagacaccaggtaagataaagccgagtgcgataatcatacctttaataattcttgaaatccaagaagccataatttcctccaaaatgtattataacgttcctattatagcataaagcaagtaaaaataattaaaaagactgcctgttagataaaatccagcaggcagttttggttaaagattgtaaaaacctggtcttgctctatagagtaaaatgagcagaatagaggcaattgctgtggaaggaagaatatagctgatattgtaggtaaaggaatagaaccagacaggcataccatctggagcgtagtctgcgtagaaaataattcctgataagaaggtggctaacaatcggatgcttcctcctagaaaactagccagagtaatgatgagagtagcattttttagattgttttgtttggatagggtgggtgccactaaacctgctaaaccaattccggcgtaagaaaatgcgtagtcgagaaaaacttgaaaaacgtttaggaagtagccaccgtagaaaagttgaatggttcctacaataccaccagtaagaactcctacccctagtccgtggcgcagagcaagcagtaagattggaagcatgactaaagacacagatccaccttggggcattgtaaagagcgggattttgtcaaagacgagggcaatggcagaaaagatagcaacttcagctaggatgggtaattttgatgtgggcataaaaagactcctttgtagatggtcaacaaaggagtgtttatagcagagtatagtatcattctataaagcacacaattcctacgctagttttaactagatcaggttcgaggatttcgcagttgcgatctcagccgaagcactcctttgtgtatatgtaattagtgaaattgtatcattttattcgggtgttgtaaatagtttctgataaacttcattaggatccttcagggtagtaataatgttgaggtctaggtggtgctcaaagccgtttacataaccacgtgaggtatattggtgaagatcgtagttcaagtcagtatttggagcggcattgtagtagccagaatcatcaccgtatgtaggaatccaaatagcgtcaaatttatccacattgatgctgtggtcttccatgaaataggttccgacgtaaattccaatgtttttagcgccgagagtttctaactcttttcgaaaagcctccactccagcattcatatcatccatggtatattcttcgacgtctaaccaatagaaggttggcttgtacttatttgcggccttataaaagcttcgagcttcctctcgcatgttctcaatactatttcccgtgacataggcatagacagcaacaggtatatttcttgcttgaaattctttaatatgggtatcaaaggatttatctaacccatttttatcagtcgcagtattttcgtttttagtgtgtgatccactttgaatacgaacgatggcgccagaaatgtttttgctaagggtatcgtagtcaatttcagacggtctctgccaagcagaaacgtcgatgataggtttcatttcgagcgcatttgcaatgtaataactcgaactagaatttgttgttttagaacttgtactggtgtttgattgtgtgactgcgggttcgttagctacctccgtcttatttacagtatttccagtcaccccagtgatgaaaataagagcaaagaaggataggaaaaaaccaacaacaatcatcggatttagtttctttctcatctcctcaattctaccgtaaaatcatgaaaaaatcaaaaaaatacgattcaagaaatagtaaaagattatctgaacttgacataataaagggaatagggtaggctaaattggtatgcatgacaaaagtgaaaaagtaagacgtgttagtcagctagttgttctgtcctatttcagtttgctggagagctggatattgatgatactagtgatggtagggagtggcttgctttttggatttggcacagttgttttgtggcaagttcttagttttgcttttatccaatttatatggtggttggcaatcggtccttttatcaaaaaagagaacattcccttgtggctacagagtcttctggcggggattcttgtctttttgtatgggctaacgataagttttttatctgctacacagtttgggacttctcctatcgtcttttggcttaatggtttagtctttgatagtttacacgctacttcaacagttttgttttatccaattattgattatatttttaggagattttataaatgaaaaaaattagtattatgttgatggttgtcttctcgctcttcttggctgcttgtacaaacactaccgagaaacagaacaactcggctatcgaagtcactttgcagattacaaccaaggacaaagagaatcgtcaggaagtcactgcggaagaaggtgatagtgtcatggatgtgcttaaagaacatcatgacattgtagaagacaatggtttgataacagaaattgatggtgttagccaagatacgagtaccaatacatactggatgtataaagttaatggccaaatggctgataaaggggcgaaagaccttacagttgcgaatggggatgaaattgaattttatcttgaaacatttgaatagatatgaaaggcttcggcctttttcttgtcgacaaaagtcagttccgaatgtttgcagagcaacttagaaagtgataagtatttttatacaaagtatgctataataagagctatactcgaagaaggttggataagcaatgaagattgacaaacgccagttgttgaattattccatactgattccctatctcatcttatcggtgattgggttggtcatggtctattcgacaaccagtgctacgcaaattattaatggtggaaatccatttagaacagtgattaaccaggcaggattctggattgtcagcttggtagcaatctatacgatttatcgtatgaaattaagttttttacgcaagaaagccgttatctattcggttattttggtagaagtatttctgttagctatttctcggttgtttcctccgattaacggggctcatggatggattcctctgccaatcgcaggaaccttgcagccggcagaatatttgaaattaattatcatttggtatctggcacatgagtttgcaaaacaacaggcggatattcggacttatgactatgtatcgttgattaaaggaagttggattccgaaagagtttacagattggcgggtggtcagtctgctcctcctaggtctagttgcgacactgccggacttgggaaatgcgacgattattgtgctgattatggtcgtgatgattagtgtgagtgggattgcctatcgctggttttcaacagcggttttaggaattgtggccgcctcaacagttattctagggacgattcgtattttgggtgtagaaacggtggaaaaaattccgctctttggttatattgctcgtcgttttgctgcctattttgatccatttggtaatgccaccaactcaggtcttcaattgactcattcttactatgcgatgagtaacggtggatggcttggacgtggtttgggaaattcgattgagaaaaaggggtatctaccagaggcccacaccgactttgcgttttcgattgtcattgaagaactcggttttgttggagctagtttaattctagccttattgttctttttgattattcgaattattattgtaggcgtccgtgctcgtagtccatttaatgcgatgatggcacttggaatggcaggtatgcttctgattcaaacatttgtcaatatcggaggaatttcaggaattattcctgcaacgggggtaactttccccttcttgtcacagggtggatcgagtctcttgattatttccatcgggatagggtttgttttgaatattgatgctagtgaaaaacgtcgattaattgaagaagaaatagagcgtacgctaatttagagataggaaagaggtaggagatggctattcaaaaattagaaaactataacaacaaggaagcaatccgtgaagaagtaacgattctaacatctattttggaagaagtagcagcccaaatgatgcctgcagagacttttgctaaaattgtagaactatctcaattgtctcgtcaagatgattatcaggcattgattgctattatcagtcagttgaataatgatgaactagcggttatttctcgatactttgctgttttgccacttttgattaatatatcagaagatgttgacttggcctatgaaatcaaccatcaaaacaatattgatcaagattatcttggtaagatttcaacaacaattgatatggtttccaaacaagaaaatgcagctgaaatccttgaaaagttgaatgttgttccagtcttgacagcccatcctactcaggttcaacgccagtctatgcttgatttaaccaagcatattcatgagttgcttcgtcgttatcgcgatgtaaaattgggcttgctcaataaaaacaaatgggaagatgagctccgttgttacattgaaattatcatgcagacggatatgattcgtgagaagaagttgaaggtaaccaacgaaatcacaaacgttatggagtattacaattcttcctttattaaggctgtcactaagttgcagcgggaatacaaacgtttggccgctgagaaaggaatcgtcttaaataatcctcgtccaattacaatgggtatgtggattgggggagaccgtgatggaaatccatttgttactgcagagaccttgaagctgtcagccttgactcagtgtgaagtcattatgaattattacgatgagcaactctataaactctatcggaatttttcgctctcaacttccattgtaaatgtatctacagcggttaagatgctggcggatttatctgaagatagttctgtctaccgtgaaaatgagccttatcgtcgtgcttttcactatattcagatgaaacttgcaaatacaagagattatttagttcacaataagccgtcagatgttcgctatagtaatgtagccgagtttaaagctgatttattagccatcaaacaatctttggtcgaaaataaatctatggcgctattgaaaggtgattttacagaattgcttgaagcggttgaagcgtttggtttctacctagctagtatcgatatgcgccaagactcttctattcatgaagcaagtgttgcggagttattggcctctgctcgtatcgtagaagactactccagtttatctgaggaagctaaatgccatgttcttttgaaacagttggaaacagatccacgcattctttctgcaacgcacatgccaaagtcagaacaattagaaaaagaattggcaatctttgctgctgcacgtgaattgaaagataagctaggtgaggaaatcatcaagcaacatattatttcacactcggagagtgtttctgatttactggaattagctgtcctattaaaagaagttggtctagtagatgtcgataaggcccgtgttcagattgttccactttttgagacaatcgaggatttagataatgcacctgataccatgcgtcaatatctgcaattagatttagcgaaacgttggattgcaggcaataaatactaccaagaaatcatgcttggctactcagattccaacaaggatggtggctacctatcctccggctggacactctacaaagcacagaatgaattgacgcaaattggtcaagactacggagtaaacatcaccttcttccacggtcgtggaggtactgttggtcgtggtggtggtccttcctatgatgcgattacatctcagccatttggttccatcaaggaccggcttcgtttgacagaacaaggcgaagtgataggcaataaatacggtaacaaagacgcagcctactataatttagaaatgctggtatctgcaacgcttgaccgtatggtcacacaaatgattaccgatccaaatgaaatcgatggctatcgcgaaaccatggatgaaattgtatcagatagctatcgtatttatagagatcttgtattcaacaatccacatttttatgattatttctttgccgctagtccaattcgtgaagtatcaagtctgaacattggctcacgtcctgcggctcgaaaaaccatcacagaaatcggtggtttgcgtgcgatcccatgggtattctcttggtcacaaaaccgtgtcatgttgccagggtggtatggagttggttcaagtttcaaacgctttattgataagcaccctgataatttgtctaagttacaaaaaatgtatgaatcttggccattcttccgttcacttctatcaaacgtggatatggtattgtctaaatccaatatgaatatcgcatttgaatatgctaaaatgtgtgaaagcgaagaggtacgaaatatcttccatgtcattttagatgaatggcagttgaccaaagaaattattttgtcaatcgagcaaaatgatgagcttttagcagaactaccgtttctaaaagctagtcttgattatcgcatgccttattttaatgtgctcaactatattcagattgaattaattcatcgtcttcgtcgtggagaattgagcaaagaacaagagaatctcattcatattaccatcaatggtgtggcgacaggtttgcgcaactcaggttaataggcataaaacaacttcttcggaggttgttttttttgctgataaaaatatataataatcataagaaagtgtaaccaaatcatcccttattcgttctattagtgaaaggaggagatgagtatcaaacttgatcaatatgaaaaagaagtcattggtattgctgaggagatttcctactatctacaaaaatctggcgccaactatgcagatagtcaggacatcgcacaggatatactagtgaaaattttagaagcagagcttgtccttcctttcgaaaaactaagagcttggctttaccgttctgcagttcgggcttacattgacaaatacaggcgagacaagcgctaccatgaaattttacaaaaggagttttttacacctgaaaattttttggtctatgaccaagaagattatgaggaactctatcaagctgttgcagacctgccagaaaaataccagcaagtgattgacttatactacttccaagatatgagtatcaaagagattgcgcatattttaggtgctggtcaaagttgggtgaaaatcagccttcaccgaggacgcaagcagttaaggaaaatactagaagagagaggatatgactatgaagacttttgaagaggtgacaaaaaagagtaagcggaaaaatttatggaagacagttggactatcatcgttcatcggctttatcttattgttgattggcattcaaactgtaaaaataattgtcggtgcacgagaaggtagtgagaattggaaacaaattattttaatggaaatctcttatccaaatataaaacatgacggtattaaaatccaaagcacgagttatgtttctgggaaactttactgcaatttatataaggatctagctggtgttcctatggcttttggtcagcacgaaatttactatgacctgtttgatcgtcactatgattttgctcagcatatacccgggaataccttcaaatatctatatgatttcacaaccaataccaagatacctgttttttacaatagaaaaaagtccgtttggagtgttcaagacattgccaatgaattgcattatcttaaagacatgagtgggcagctagtagaagtggctatttcctttgataagaagtatagtttggcagaaatcaagcaaatgattcccagcaatctcaagcaaaattggtattggatagggacagaagggaagcagaatacccattactatcgtccagagcagcttttggggttagatccagaggatattcaactagtcttttcggatatgcctggagactatatgacaggtatggactttatgaaagagttcttagaatcgggagatcagaaacgagcgcagtatctggacatacctgtggatgacttgcaagcctttgttgacaaatttggcgatacagactttactaaacaagaagagattgataagctagaatttgcaggcattatcctaacaggaaaagcagaagactttgcccagttggaaggcaaggactggatttattcttctagtattggcgcgtccattcctattcagccttattatcaactgcatcattaagtgaaaatagtcaatatattttcaacacctatagcaagaggcttgtcagggagtcgtaggataactgaatggagaaaggtctgtcgcagtggtctcgtatttgtggcaccttgtagctatggtaacatcaatattcttacggaaatgaggtgtttttagttgagtaataggttaaaatgggatgataaaaaaagttataagcgaagctaatagcccttgcagaaaatggataaaataaaaaacgatagaaaatgcttgcaattctgctacaatttgatagaatagtaaggtaaagttagactgtattgcctactgtctatctataaaatatattttattggaggcttttaccaaaatggcaaaagaaaaatacgatcgtagtaaaccacacgttaacattggtacaattggacacgttgaccacggtaaaactactttgacagcagctatcacaactgtattggcacgtcgcttgccttcatcagttaaccaacctaaagactatgcgtctatcgatgctgctccagaagagcgcgagcgcggtatcactatcaacactgcacacgttgagtacgaaactgaaaaacgtcactatgctcacatcgacgctccaggacacgcggactacgttaaaaacatgatcactggtgctgctcagatggacggtgcgatccttgtagtagcttcaactgacggtccaatgccacaaactcgtgagcacatccttctttcacgtcaggttggtgttaaacaccttatcgtcttcatgaacaaagttgacttggttgacgatgaagaattgcttgagttggttgaaatggaaatccgtgaccttctttcagaatacgatttcccaggtgatgatcttccagttatccaaggttcagctcttaaagctcttgaaggtgactctaagtacgaagacatcgttatggaattgatgaacactgttgatgagtacattccagaaccagaacgcgacactgacaaaccattgttgcttccagtcgaggacgtattctcaatcactggtcgtggtactgtagcttcaggacgtatcgaccgtggtactgttcgtgtcaacgacgaaatcgaaatcgttggtcttcaagaagaaaaatctaaagcagttgttactggtgttgaaatgttccgtaaacaacttgacgaaggtcttgccggcgataacgttggtgtgcttcttcgtggtgtacaacgtgatgaaatcgaacgtggtcaagttatctctaaaccaggttctatcaacccacacactaaattcaaaggtgaagtttacatccttactaaagaagaaggtggacgtcacactccattcttcgacaactaccgtccacagttctacttccgtacaactgacgtaactggttcaatcaaattgccagaaggtactgaaatggtaatgcctggtgataacgttactatcgacgttgaattgatccacccaatcgccgttgaacaaggtactactttctctatccgtgaaggtggacgtactgttggttcaggtatggttacagaaatcgaagcttaattcgattgagttcccagaaataacaattatagtcagacaacttaattgtaactctctactttcgggtagagagtttttctgtaagtattcataaaatgcacagaaattctttaatcttagctaagtttatgctataatgtaccttgtaaaataaatatagaagaggtaagtgaaatgtcacgtaaaccaatcattgccggtaactggaaaatgaacaaaaatcctcaagaagcacaagctttcgttgaggcaattgcaggaaaattgcctgcaggcgacaaaattgaagcagctatcgcagctccagctgtagatttgaacgctctcttatggttcgctaaagattctgaattgaaagttgctgctcaaaactgctactttgaagatgctggtgccttcactggtgaaacatctccaaaagtattggctgaaatgggtgttaactatgttgttatcggtcactcagagcgtcgtgattacttccacgaaactgatgaagatattaataaaaaagctcatgcaatcttccgtaacggtttgactccaatcatctgttgtggtgagtcacttgaaacttacgaagctggtaaagcagtagaatttgtaggtgctcaagtttctgcagctttgaaagacttgactgctgatcaagtagcatcacttgttattgcttatgagccaatctgggcaatcggtactggtaaatcagctactaaagatgatgcacaaaacatgtgtaaagctgttcgtgacgttgttgctgctgatttcggtcaagaagttgcagacaaagttcgcgttcaatacggtggttctgtaaacccatcaaacgttgctgaatacatggcatgtccagacgttgacggtgcgcttgttggtggtgcatcacttgaagcagaaagcttcttggctttgttgaacttctaataacaaaaagcatcggattttgaattcgatgcttttttgatattttaagaggctacttcagtacccattctctaaaagcgtgggctacaccgctctcatcatttgatttcgtaatgtatttggcgattttcttcaattcaggatttccgttttccatgacaacaggattaccaacaacttccaacattggacggtcattttcttggtcaccgatggccatggtttgatccatagttagtccaagcttctcagctagatgaatgatagcttgtcccttgttaacagttttaggggtgatttccaaataaaatggtgctgattttgctacgttgtacttctcagtcaagatggtcggtagaagtggaatagcagcatcaagaatttctggctcatcaaccatcattgttttgatgatttccttgtcagccatttcttcaggagtgcgatagaaaatgggtgcacttactagtgtggattcgtaaatggtgtatttaccgatgttacggttggcagtatagataccttccttggtgctggcatgcattgggagcttgagtttacgggcagcagattcgatgtcgagataatcctcataagtcaaggtatctttgacaatatcctcaccagttgctgcatcttggactaagccaccgttaaaagtgatgacgtagtcacctgcttctgtaagattgagttcttctaaaattgcttgaacaccggaaatggggcgaccagtagcaataacaattttaacgcctgctttttttgcttcttggattgttgagtgtacttcagctgtaatttggtgttgactatttagtagtgtaccatcaatatcgatggcgacaagtttaatgctcatttgattctccaattataaaatgatcgttatgtatgtggctgttaaaatcagctatttgaggtgcgaaaattcctgtttcttctaacatttcttttgggaaatagaagcggctatcgccatggattgtgcctgataaggaatggacaattggtgatagagaggatagttctaccaaggtttcatctttgcgataaatctcaatttgagtccgtttcttttctgcattcggtcggtaaatgtcatacggcaaatcaaagttgtggtgaatagcagtatagtattctgggtcaaacccgacgtctgcgaccaggctacgcaggcggtccaaagcttcctcttcttcggccttgaaagtgatggatttgagcactttcctattgatatagcgctgggctaagtcagataatatacgatctggtccatctatccatgattgaaagtaagtattcataactccatcatccagactgaggtagtcggttagacggatacgatgctcaaaaaaaggtaatagccgaggtgaagttcgtgcaaaaaactcctgttcaccagtatatagtagtttggcacgattgagtaaattctgcaataggacttccatagagcggcttgctggatgaaaatagacttgcatgtacatctggtagcggctgagaacgtagtcttctactgcatgcataccagattctttgaaggcaattccattttctgtcgggcgaatgacacgtaatatcctagttaggtcaaattcaccatagttcgcacctgtgaagtaggaatctcgtaatagataatccatccggtcaacatcaatctggctcgaaatgagttgaacgacctgtttatttggataggtgtgtttgataacactagcaaccttgtctggaaactcaggtgaaacttgtttcaacagagcattgatttccgtttctggactagtaataatagcacaggtcatttcctcatggtctgtatcaaatagacgctcgaaggtatgagaataggctccgtgtccgacatcatggagtagcgcagcaaccatggtcagtagggactcatttgtatcccagatttgtggatacttgtcttcaaatttttgagtaatccgtctggcgatttcgtaggcgccaaggcagtgcgaaaagcggctatgctcgccaccatggaaggtataggaagtagtccctagttgcttgatgcggcgtagtcgctgaaattcttttgtattgataagtttataaatcagctcatgatcaacatgtacatagttatgaactggatcgcgaaatactttttctatcatagtttcattataacaaaaaagggagataaattcctgatttttctaaaacacaaggatattgctatgtacccaatggaatcttttggtataatggagaaatgaataatcaaattatcttattaactattcaggtctttattgtagccctgattctttggatgctttacacaattctatcctatgctaaaaagcacgatatttctctaaaagagaaattttggacaggatttggtatcggttatgttactgatttgctagacaccttggggattggaacctttgcaacgacaaccactatgtttaaactgacaaagttggtggaagacgatcgtaaaattcctgcgaccatgacaacggcgcacatcataccagtcttagtagaggcgctattgtttattacgatagttgaggttgatatggtcactctgattgctatggcagcagcggcatttacgggtgcctttgttggtgccaaggtaactcaaaaatgggatacaaagaaagttcaacgaattcttgggattttactaattattgcagcctgtttcatggtctatcgcatgattactaaccctggcgcagatcttaccaatgaagtaaagggcttaactggttggaaactggctgttggtattgcctttgattttatggtgggaatgctgatgagtatgggactgggtaactatgctcctgagttaattttcttctcattgatgggaattagtccagcggttgctcttccagttatgatgttgaatgctgctatgattatgacagctggtgccaagcagtttatccaatcaggacgagtaaactggccaggagttccaggaatcgttgtcggtggggtgctaggtgttttgacagccgctttcttcctatcaaatttggatattaataatttgaaaattttagttgtcttcattgcagcgtatacaggttttactctgcttcgttcatcctttgttactaggattaaaaaatagtaggaggaactatggatattcatttacgaaatgaaattgatctggacgggcagattgaggtagtggatcagcaatttcaagtggaagttaaggaaaaagatgggaatctctatctcatttatagtaacgatgaagctgaaaaagttgtcataaaatgtgacgaagaagagttagtgatgacacgcttttccactccgaagtctattatgcgattcatttctggtaaagaagctattgtgaccattcctacaccgttaggaatccagcattttgtgaccgatacaaaacgttaccaattaaaccgttcggatcaaagtgtccagttgcaatatgaattaaagggattggagaaccagcagctttttgcttcctatgatttggaaatctcgtggaaataatggtaaattctcaaagtaagttctagttcccgtccttccagaagttactctgagaaaactgcataacatcaacagaatttagtctcagactaagttctgtttttgactaaaaatgttgataatagtgagttttagggttgaaaatgttgaaaaaagagtacactaaagttactggctctgagacgtctcaaagtaagttctagctatctggaattttggatggaacaagttcctttctattttgaaattattttttgataaaaactagcgattacttatccaataatcgaggtgattgaatgacgttctcagggtcaattttagagattcccaaaagtgttgccaattcctcaccgtaggtaaatgtaaagagttcataggctgattttccgttgaaagaagctcgtttgacgctgttgatatgcgaacaaaccaggttgatgtcctcctgtgtcaagttgtcaaaagaacttcttttaggaagaatatctctgataagtgtgtgattcttctcaattctccccttctggtcagaacgattggggtcacagaagaatagcttagattctccgcgaacatccatttcgatatcgtccactctagcgaattcaccgccattatcggtcagaatgacaggaaatatttcgcaaaagtccatctctttctgatgcaggtcattcttgatagcgtagagatgtttagcgacctcattagctgttttattatcaagtaattgagcgaagataaagttacagaaggagaggttaaaggtgagaagtacctttccgccgatccgtccagtaacggtgtccatttccagccaatagctgattcctttctctgtgagaaagcgttggaagtcctcgtaagaccgtccttctttggcgattttaggaatgggttgtaggtttctgattctccgctttctgaatttcacgacacgggggaaatcaatgggctttgtggacagatagcctttttcaaggtatcggtagatagaagctctggatgccgacatttcgtttgaggcgatgatgtggttgaggtgttgtcccttttggatggcagcagaaacaatctcatccatgcgatagaattcttccttgtttagtgcaacacctgttctcgaatctgagagcttaacttcataatcaagctgagctctttttgcgtagtagaactgtttctggtatccgcagttgcttctctttttcggacaggcattacaaacgtaaggagtctttttgagtagagggcaagcctcacaattggaggtactagagttctcttttatcaccctatttctccgaacttcttttgaaattgtggacggatcttttcctaacttagctgctatagctgagaagggcttaagttgttcaattcctatttgaatatcattgcgatcagagagagttaagtgtttgtttttcattgtcagttaccaacttgtcccatagtaagttctaccttatttctttgtctcagtctaatttccagtttttaagacagactagaacttactttgggaatttactaaacaaatgaaagttcaggttttatggtaaaattcttgtttttcttcaaaaatatgatatgatagttaacaatataccagacggaggttgtgttaatagtgttgaatgtaaatgaattggtcaaaacagaattgcattgtcatttggatggctcattgtccctcggagtcattcgacaattggcacagatggctaaaatcactattcctgcagaagatgaagcattaagaaaattagttagtgttcatggaaaagttgatagtttaatggcttatttaaagttatttgattttgttcgcccactcttacaaactgcaacagctttagaattggcagcctatgatcttgtacgacaagttgcaagtgataaggtcatttacattgaggttcgttttgcaccagaactgtcgacggatcaagacttgactattttagaagcggtctcagcagttttagttggactaaacagggggcaggaagattttggagtggttgctaaacttctggtttgtggtttaaagcaaacgaatacgaatcaaacgaaggaactctttttggctattgctgatttggcaccaaaaggacttgtgggatttgatttcgcaggaaatgaagcagactatcctacggaagaacttcgggatattattcaatttactcagtctttaggttatcccatgactttccatgccggagaatgtggatgtgtgaccaatgtgattcaagctcttgaacttgggattagaaggattggtcatggcacagcacttactcgcaatcctgaagctatccaagcttttgtcaatagcggagcaacacttgaaatgtgcctaacatcgaatcttcaaactggtgcagctgattcgattgaatattttccatatcgtgagctagttgaggcaggagcaaacatcacaatcaacacagataatcgtaccgtttctaatactacacttaatagagaatatcagttatttgtagaatattttgggactagcaaagctgatttttaccgcttcaatcaaaatgctattcaggcaagttttgccagcgaagaagaaaagaaagttttgttggaactcctagaccaacagtattaagaaaaaagctctataccggtcgattagaccagtaaagagctttttactgtagatttaatttctttgtcataatgaagtgggttccaaagtagtaagcaaaagctaggataatattgactaatgctaagactggacttggatagagagaaaatggtgtagaataagctgttcctaggttacttaggacaaagaaagtgctaaatactccagtaacgatgagaatgccgatataagtcaagattgcaaagaggaagcgatgatccttgaataattgaccgacagatatagagaagtagatcaaaaggataccagtggtaatttcaattaaataatagacaatctgactgaatagaattgtccagtcgatagcttgaacaaaagtttgtatttctggcataatagcttcttcgcttgctgctagaatgactgcaaggatgattccaattgaaagtaagcaagtaatacctgccaagatataccaaacaatagaggcaagtagtttgcttaagataatctgatggctagataccggcagggtcatagtgagataaccttgtcggccataaacattttttctaaaacggttgattactagaacaaatgttgacaagaagagtgcggcaattaaaataccaaaagtcataaaggatgttcccaataagaccatctctccaccgccaggttcagtatttccagcctgtgtacggagggccaacgcttgtagccaaaaaccaagtactgctgataggaccacagctgcaatataaattcccaaataccatttacctacggattgaaattcgtatttcaataattttttaaacatagcaatctccttctaactaagccttaaaatcttggcggaagagttcgtcaatagattctccgctttcaattcgcaagtcatctacattcccatggcgaataacgcttccgtagtgtaggaaaataacctcgtccaaaatttgctcaacatctgaaattaagtgagtagagataataacagaggcagtcggagaatagttgttgacgatggtttttaaaatgtagtctcgggcggcagggtcaacaccaccaattggctcatctaaaacatacagctgtgcttgacggctcatcaccagaatgagctggactttttccttattccccttggagagatgtttcatacgactgtttaaatcaatacccaaatcttgtaaaagatggagagcacgctccttatcaaaatcagcgtaaaaatcttcaaaaaatgtaactgcttcgagcactttcatatgttcatcaagataagtggtatctgggagataagatacaatcgccttggtttctggcgatggtgtgcgaccattgatcaatacttgaccatattctggctgcaacaggccgttgatcaatttaatcatggttgttttacccgaaccatttggtcccaaaagtcctatgatttttccggcagctaacttcaaattaacattatttagggcgacagctccaccataagattttgaaacttgctgtagctcaaccaaagtatatgcgttactcataagtaactcctttcaaataatcatctaactggctagtgagttcatcgtgtctaaagcccaattctaacatattgttcacgaagttctccagttccttttgggctaaatgtaggcgagtttgtgtaatcaattcttgattatctgttacaaaacgacctgttgtgcgaaccgagtaaacaaatccttctgtttctaaatcagacaaagcgcgctgaacggtatttggattgacgccagcaatttcagctaagtcacgaacagtgggaagtttatctccagattttaattgattagtcacaatctgcaatttaatagtattgctgatttgaatatagatggggatgttattatcaaatttccaagccataatcatttcctttctaggatgacaccgtgtttatgtcttatcttaataatacaataaactatataaattagcaagaaaaatgttttgaatttttaaaaaatatttttggataaatatttgatataatagaagaaacatgaaaaggagaataccatgctggcacaattagatacaaagacagtttatacctttatggatagcatggtgacgatagagagttatgtaggcagggctaaagagcttggttaccacgcattggggataatggataaaaacagtctttatgcagcctatagttttatggaatcctgtaacaaaatggggcttcaaccaattattggttgtgaactggactggaaattacagggagaggagcaggacatcactactcaattgattgctctgacaaccagaggttatcgcaatctattgaaaatttcgactgctaagatgacagggcaagatgattttgaaactattcgtcaatatttagtcgacatagcagtggttgttccttatttttctggcattgagcaccttgagttgggtgtaaactattatatcggagtgacagttgacacaccggttcaagattttaagcaagcaccccttccaatccatactgttcgtttttttgaagaggaacaattggaaagtctacaggttctccatgctattcgagataatattccgcttaatcaggtttcagatgtagatagtcggcaaaagcttttatcggctgatagcttaaccaatctattttctaatcggtttccgcaagcagttgataatttacgtgacttggttgcagggatttcttatcaattaaatacagatttaaaattgccgcgttttaatcgtgacagacctgcagtggaagaattatacgagcgctcctatcaaggattagaagagaagggcttgactaattcactgtataaggaacgcttggaaaaggaattatccattattcatcaaatggaatttgatgattatttcttgattgtatgggacctacttcgttttggacgtagccaagggtactacatgggaatggggcgcggttcagctgttggaagcctagttgcctacgccttaaatatcacaggtattgatcctgttaagcataatcttctctttgaacgctttctcaatgctgaacgttattcaatgcccgatattgatattgatattccagatattcatcgagcagattttattcgttatgtacgagatcgttatggttcaacccatgctgctcaaattgtaacctactcgacatttggagctaagcaggctattcgtgatgtatttaagcgtttcggaacacctgaatatgagttaagtaatattaccaagaaaatttcatttagagatagtcttacttctgcctatcagcgaaatgccgcttttcgccagattatcaatagtaagatagagtaccaaaaagcttttgcgattgctcaacaaattgaagggcaaccccgacagacttctatccatgcagcagggatagtgatgagtgatgaggagttgacagataccatccctcttaaaataggggatgacatgctggtaacccaatatgatgcacatgctgttgaggcgaatggtctgttgaaaatggatttccttggcttacgaaatctgacctttgtgcaaaaaatggcagaaggagtacgtgaacgttatcagcaggaaattgatattgccaagatagatttagaagacaagaaaaccttggaactttttgctgctggtcggactaagggaatttttcaatttgaacagcctggtgcgattagcctgcttcgaagggtcaaacctggtcgatttgaagatatagttgcaacaacgagtttgaatagaccgggggctagtgattattcggataactttgtaaaacgcaaacatggacaagagacagttgatttgttggatccaaccattgctcctattttacaaccgacttatggtatcatgctttatcaggaacaggtcatgcagattgcacaggtctatgcaggctttacgcttggcaaggcggatttactccgcagggcgatgtctaaaaagaatgcgcaggaaatgcaggcaatggaagcggaatttttacagggagcactgaaaaacggacatgctgaagagaatgcaagggaaatatttggcatgatggctaagttcgctggttatggttttaaccgtagccacgcctatgcttattcagccttagcctttcaaatggcctatttcaagagtcactatacggatgtcttttttgatgtcatgctcaatcattctagcagtgcttatattgaagatgcgatgcagtttgactttgaggtagctcgactcacgattaacaatattccttatcacgataagtttgataaaagtaaggtttacctaggattaaaaacactgaaaggtttgcctaaagatttagctttatggatattggatcatcgtccctataagtctgtagaagattttattttgcgcttgccagataatttcaagaaaaaggatttactaatccctcttattcagattggtttatttgatgattttgacgccaatcgaaaaaagattattgaaaatctagacaatctctttgtctttgcagaggcaattggtacattttttgcagaggagagttatagttggacagatgtagaagattacagcgacagtgaaaaatttatgctagagcaagaattgctaggtgttggtattagtccgcatcctttagtcaatatttgtcgagagtctaagcgtagttttacagatttggctgatttagcggttggcaatcgagcgaccgttcttgtgcagattcaagctattcgattgattcgtaccaaaaagactggggagcagatggcatttcttcgagtgacagataccaagaggacgcttgacgtgactcttttccccgaatcttatcgccaatacgcttctattttggaagaagggggaatggggtacatcacaggtagagtgcaagagcgggatggacagttgcaattagttctagaaaaattagagcctgtcagtttagagaaattttggattcttttggaaaatcgagaacacgattatgctgttgctcgtattttggataaatatagaggaagcattccagtagtacttcattatcaagatagtaatcagacaattcaggctgagcaccacatggttatgaaaacgcctcaattagaagaagagttaagtgaatttgttatgaaaacgatttttcgataaaaaaatagcaaaaagtcaagcaagtttaggctaagtatgttataatagggcagttaaaatgaaaagttaaaggagcattaacgaatgaaacgtattgctgttttgaccagtggtggtgatgcccctggtatgaacgctgctattcgtgcagttgttcgccaagcaatttcagaaggaatggaagtttatggaatcaacgaaggttacgcaggtatggttgcgggtgatatccatgaattgtctgcacgttctgtaggtgatattatttcacgtggaggaacattcctttgttcagctcgttatccagaatttgccaaattagaagggcaacttaaagggattgagcaattgaaaaaacatggtatcgaaggtgtagttgttatcggtggtgatggttcttaccacggtgcaatgcgcttgacggagcatggtttcccagctattggtgtacctggtacaattgataacgacatcgtgggtacagattttacaatcggttttgatacagctgtaacaactgctatggatgcgattgataaaatccgcgatacttcatcaagtcaccgtcgtactttcgttgttgaagtaatgggacgtcatgcgggagacatcgctctttgggctggtattgcttctggtgcagatgttatcgttgttccagaagaagacttcaatatcaacgatgttgttgatcgcattaaagcgggctacgataaaggtaagaaacatagcatcattgtcttggccgaaggtgttatgccagcggcacagtttgctgaagaattgaaagcagcaggcgatacaagtgatcttcgtgtgacagaacttggtcatatccaacgtggtggttctccaacagcgcgtgatcgtgtactcgcttctcgtatgggtgctcatgccgttaaattgcttaaagaaggccgtggaggtcttgcggtaggtatccgtaacgagcaaatggttgaaaatccaattcttggaactgcagaagaaggtgccttgtttagcttgactactgatggcaagattgtagttaataatccgcataaagcagatttggagttggctgatttgaaccgtaacttgtcaatctaggtatcattgtttaaaagtgttaattaagggtcatatgaccattgaaataaaaggagttttgttaagatgaacaaacgtgttaaaattgttgcaacccttggtccagcggtagaaatccgcggtggtaaaaaattcggtgacgatggttactggggtgaaaaattagatgttgagtcatcagcacagaaaatcgctgctttgattacagaaggtgccaatgttttccgtttcaacttctcacacggtgaccaccaagagcaaggtgatcgtatggcaacagttcgtcgtgcagaagaaatcgctggtaaaaaagtaggtttcttgttggatacaaaaggtccagaaatccgtacagaattgtttgaagatgatgcaaaagaatacgcatatacaactggtgacaaattgcgtgttgctacaaaacaaggtatcaaatctacaaaagaagtgattgctttgaacgtagcaggtggtttggatgtctttgacgatgttgaagttggtaagcaaatccttgttgacgatggtaaacttggtttgacagttgttgaaaaagatgcagtaaaccgtgaatttgttgttttggttgaaaacgacggtgtaattgctaaacaaaaaggtgtaaacatcccttacacaaaaattcctttcccagctcttgcagagcgtgataatgcagatatccgcttcggtcttgagcaaggtttgaactttattgctatctcatttgtacgtactgcaaaagacgtagaagttgttcgtaatatctgtaaagaaactggtaacgaccacgttcaattgtttgcgaaaatcgaaaaccaacaaggtatcgacaacatcgacgaaatcatcgaagcagcagatggtatcatgattgctcgtggtgacatgggtatcgaagtaccattcgaaatggttccagtttaccaaaaaatgattatcactaaagtgaatgcagctggtaaagcagttatcacagcaacaaacatgttggaaacaatgactgaaaaaccacgtgcaactcgttctgaagtatctgacgtattcaatgctgttatcgacggtactgatgcaacaatgctttcaggcgagtctgcaaacggtaaatatccagtagaatcagttcgtacaatggcaactatcgctaaaaacgcacagactcttcttaatgaatatggtcgtttgaactctgatcagtttaatcgtgcctctaaaacagaagttattgcttctgcagtaaaagacgcatgtcactcaatggacatcaaactagttgtaacagttacagaaacaggttactcagctcgttcgatctctaaataccgtccagatgcggacatcttggcagtaacatttactgagaaagtacaaaaatcattgatgcttaactggggtgttattccaattgtaacaaaccgtccagattcaactgacgatatgtttgatttggctgaacgtattgccaaagagcaaggtcttgttgaagcaggagatgacattattatcgttgctggtgtgcctgtaggtgttgcaggttcaacaaatactatgcgtgttcgtacagtaaaataataaaaaggtccgcttggacctttttgtagtaattagagaataagttaaatacgtgctgttatagattttttgcctctaaatgattttgggatgttgatataaaaaataaataagagtaagaataacttgttcaaagaatataaatataaacggaggaaagatgaacattcaagaacgattttctttgagaaaatccgcggttggcttggtctcagtctctttgctatgtgctatttatacatccactgttgctgccgatacagttgttacaggagtgaatgaaataattgaagaatcacaagtcaaggatgaggtatctattgaatcagaaaaaaatgaatccctagatggttctaatattgaaattgtagaggaaatagcagacaacatcccatcacctgttatcgctgaaggggaagtagcggtagagatgaaagttgacagagggaccgagaatgtagtttctagaaatgatacagaagttacgacgagcgagcaaaatcagatagaggttactgagacaaaagaaattttgaatcagaccagttatcaaacggagagtggcgagcaacgacaaattatatgggcccatggaattactcctcctgcaatggaacaaagcggtggttttgtaaaggaaaagtatggagactatttaaactatacagcgccatttgaggctggaaaaggctactatgataccaataagagtctgaatgcttcatttattgaccttaatctttgttttgcagctgtgtcttcaaacatggtacattggtggttggaacagaatagttcctatgttgagcgatatctcaaagaaaaaaagggtacagtaaatgttgaagaaaactacgcaataacggacttacggcgctatattaattcattccaaaatcaacaaaatagtcgagtttttgatatgttcaaaacttactatggttatcgtacaaatggttttgtatcagatgccttggttgacttgtttattaacggatataaacctaaggcacagggcggtgtcaatctggaagatagccagttagtaccagatagtaggggtggctttttctacgacgttttcaaagagaaaaaactgacaaatcgaatttttagtggtagttatgagcggtttggtgaggatgttcgaactgttttggaaagcaaaggattactcggcttaacttatagaacattaggttatgcaacgcatattgtgacggtatggggtgctgagtacgacaatcaaggtaagattaaggctgtctatatcacagattctgatgatcaacaagaacaaattggtttgaagcgtatgggaatcactcgtgatgcttccggaaatccacgtttgaataatcatatgaaaaataattcagctggagcgcttttggattatgtccatacaatccgtctgggtcaagacttatgggaagaatatttcaatccgcttgcaaaagccaaagaaacagctagtcagacattagccgatacaaagaaggcgttggatttgtctattcaaggacaatctgaattgccagaatcaatgcgactgatttatcttgaaaaactaaataatctctataatcaaggaattctatctattcaaaaggcagaaagttctgagatgctaagtggtgcattggaaaatggtttaaatagtttaaagagtttagattttcctatttcagaagttggaaatgctttggcaccagatttaccagtaggtgatcgctcaacggtttcagatgttgattctctatcatctcaagaaacaagttccacaaatttggaagcagacacagagaatgcaggtattattgcagatggtaccaatcaattgcattttccagtggaggcccaaacgacatcttcagtagaggctgagggagataatgtttttgaacaagaggcagatacattaccaataattattgaaaacaaggatgaatttggttcagaactatcaagaaacatgcaaacgtcagaaacggattcgctagtagtagctgttgaagaagatgtgaaaaatgatgaggtagcccaagttgaagagcttcttgaatcagaaaaagttgaaaatcagagttcggaacttctgtcagacaccctaatcgtagagagtgcaaatgacaaagaagaagatagagtggaggcggttgtttctgaacaaccagactcaataccacatcaaaatgtagaaatctctcttgtagaaccaacgaatgtcgaaactgaaactgtggtcactcctattaatgatgcagctactcctcatggttccccgacgtatatagataattccgtaactgaatctgtagctactccacttgaaaaagactccattcaagccggggagacagagattgcagaaccaacctcgagcgaatcaacgaatgtcgaaactgaaactgtggtcactcctgttaatgatgtagctactcctcatggttccccgacgtatatagataattccgtaactgaatctgtagctactccacttgaaaaagactccattcaagccggagagacagaaattgcagaaccaacctcgagcgaatcaacgaatgtcgaaactgaaactgtggtcactcctgttaatgatgtagctactcctcatggttccccgacgtatatagataattccgtaactgaatctgtagctactccacttgaaaaagactccattcaagccggggagacagagattgcagaaccaacctcgagcgaatcaactagtgttgaagctgaacttgtcgacaattctgaaattcatgcagctacctcttcagttactccctgtggctcctcggcatatgcagatggttccacaactgaatctgtagccactccgcttgaaaaagactccattcagactggaaatacagaaattgcagaaccaacctcgagcaaatcaactaatgtagaagctgcatctgtcgacaattctgaaattcatgcagatgcctctctaactgctgtttcatcagttaatctggataatccagtgattgaaccagtagctatctcccttatcggttctaagagggacacgaatgcagaagtagaagtttcttcattatcgaaaagagaggttagaaaaacaaatactgacgggctaatctctgttcaatcaaaagttattaagaaagaattgctagaatcaagcttagcagaagcagggtctccattgctagaagccaccattgctcagtcttcaaactcaaatagtactgagataggtatgagctatcagaatactgtgttattagagtctaataatacagagcgtcaggtgtctaaagcagaaattgttatggaacacaaggagacagagttagttgaaacggtttcatctgcttctgagcctgtagtgctcgtagaaaatatctcacaaacctcaaataatactattgaatctggtaagaatatgggagttcaatctcaagcaggtgcaaaacaaattttaggcgtagaacaatcttcgaaagtaagtacacctacttcaagacagattatgggagtcggtctattgactcttgttcttggtagtgctttaggtttgttaaagaaaagacgtaagtaaaagaagtatcgtcatttagtttttcttttattacttcgttaactcgccttacctaactccagttatgcctgcggctcgttgcctagtactaaaagtaaactaaaagactatattttcaacgaattaggtttttaagtgaatcagtttctatggttgcgataacatgctatagataatcctttaatagtttgagactagaatggtagtattctagatagaaataagcaacgaggttccccgttgcttattgtatttattggttagataacaactagtcttagtatctacatttaaagggttagtagaatctaaacgtatcgtatcttattttttgagaatatatctatttggagaatatggtgtacggtcaaagtttgtttcttgattgagaatttctttagcaatttgccaaccgataattggaccgtttgtcagaccggtggagcctagaccactagctacccagacattaggcatatcctcaatatttccgtagaatggtgaataagttgaagtataggcgcgcgttccaatgcgagttctggttacaggatagtttgccaaatcaggcatgaattcagctattttatcatgcatggcttggattttttcagggtctagttctaaatcgtagcccatgtcatcttcatgagttgcaccaataatgattttcccattttcaaatggtaggatatcaatctctccgtaaggcatacaaactggccaattgtcggtatcgaattctgtatctaattcgaacaattgtcctttttgtggtcgaacatccacttgatagccaagaggttcaagaatatgtggtaaccaggcccctgtggctaagataatatggtcagcagtaagcacttgattatctacttcgacagtatggttgtcgagcagttttgcctgtccgtagatacgtgtaccaccatttttcaaaaattgttcctgaagaatatcaatcaaacgcccaccatcaatacgaccgccaccttctaaatggataccaaaatagtctggcttaagtagtggcaggtactggttaatttccgagcctataagcggagtaatttcgccaatagtcggagtatctacgcgacgttcctcggcaattttttggattttatcaagtagttcaggcttactttttaggccgatggttccagtctgtttgaatggaatttcagtagcacccgatttttccaaatcggctaccaattgacggtagaaaacagcaccatcggaagtcagcttataccagtctttattttttttctgagccatccatgggccgatgatacctgcggcagctcgtgtggctgttccgacccctgaatcaatgagagtaagattgacttgttcttcttgggagagataaaaggctgcagtagagccaacaattcctccgcctataataataacttgttttttcataagttaattatatcacaaattcagaagtttatttatttttttcaacatgatacaatagaaaataagaaaaattgaggagttcgtgtgtcagatataatgtatcctgaggtcctaactgttggaagtggggccgtaaaagttgcaacagtcggagatagtttgacttatggatatggcttggagaatcgggaaaaagatgcctatccttgtattctagctgagaaacttgggcatcactatcaagtttcaaattatggattgagtgggcgttcacttcagtcaactgcagattttccttactttaaagagaagaatgcccaactttcacttgagagtgaagcagatattgtcatcatcatgattggtagtaacgatagccgaggaccatattggaatagggagaggtttattcaagagtatagggaaatggcagagcagtatatggatttaccaagccagccggatgtttatttagtcatcccgccttacgtaccaaccagtcgttttggattgaataatcaaattattgaagatgaattacaaaaaattatcccagctatcggaaacgaacttggtttaccagttattaacctttacactgtgacggagggacatcttgaatactatagcgatggtcttcatttgacaccgttaggaaatcaagttattgctgaagagatttaccagcatctcagacactaatggctctaaattgtggtataatactagtgaaatggagagattatggtaaaaagagatttaataaaacaaatcagtttattggtcttattgatttttggaatcattggcctacgattttggttacttgagccagtcacgattacccctgagatggcaaatagttatttgaaggaaaatgactttatcatgacagtgcgaaatgtccgcccgattcatggagattttattttgtataaccatgagggaaaagagtatgtgagtcgtgtgattgcattggaaaacgagacggttacctatatggacgatgttctctatcgtaatgatattattgttacagagaactatttaaaaacgcctcattcacaagaaagttatacagatgactttacattggaaaccttgacaaatggaaagtacaacatcattccagagggacactatttggtgttgaatgatgtacgaacgaatcaacaggatagtcgtagttttggtttgatttctagtgaggctattgttggtagactgacttttcggattagtccactttcagaatttggttttattaagacagggctggttcagtagaatcagctttttttattgtattgagatggctggaactgtattttgaaattagactagaccaattaaaatgttgacaaggatgaaatcttgttatatactgatttcactggtctttttagatataaattagactagaccaatttttaaagaaatgaaagccgatgttaacaaacatcgtaggtgatatgtatgtgtggaatcgttggtgttgtaggaaatacaaacgcaactgatattttgattcaaggacttgaaaaattagaataccgtggttatgattcagcaggtatttttgtgacgggtggtgagcaagctcatcttgtgaaagctgttggtcgcattgcagaattgtctgcaaaagttggcgataagactgaagggacaacagggatcggtcatactcgttgggcgactcatggtaagccaactgagaacaatgctcaccctcacacttctcaaactgctggacatatcctagttcacaacggtgtgattgaaaactacgcagaaatcaaggaagagtatcttgcaggtcatgacttgaaagggcagacagatacagaaattgctgtacacttgattggtcaatttgcagaagaaggtttgtcaactctagaagcctttaaaaaagcattgaagattattcaaggttcatatgcctttgctttgattgatgctgcggatgcagatacaatctatgttgccaaaaataaatctccacttttgattggtcttggtgatggctataacatggtctgctcagatgccatggctatgattcgtgagacaagtgaatacatggaaattcacgataaggaattggttatcgtgaaaaaagatagtgttgaagtcatggactatgatggcaatgcgattgaacgtggtagttatacagctgagcttgatttgtcagatattggtaagggaacttatccatactacatgctcaaggaaattgatgagcagccaactgttatgcgtaaattgattagtgcctatacaaatgaagctggtcaggtaacagttgacgcggatattattaaggcagtacaagaagctgaccgtatctatatcttggctgctggaacttcctatcacgcaggatttgccgcaaaagacttcttggaaaaattgacagatacaccagtagagttgggaatttcatctgagtggggctacagtatgccacttttgagcaaaaagccactctttgtcatgattagccagtcaggtgaaactgctgatagccgtcaggtattggttaaagctaatgaaatgggcattccaagtttgactgtaaccaacgttcctggttcgaccctatcacgtgaggcaacttacaccatgttgctccatgcaggaccagaaattgcggtagcttctacaaaagcctacactgcacagattgcgactttggcaatcttggcgaaggctgtcggtgatgcaaatggcaatgcctacgcgaaagaatttgacttggtgcatgaattgtccatcgtagctcaatctattgaggccagcttgtcagaaaaagatgtgattgctgaaaaagttgaaaaactcttatcaaccactcgcaacgcattctatatcggtcgtggtagtgactactacgtttctatggaagccagcttgaaattgaaagaaatttcatacatccaatgtgaaggctttgcggcaggtgaattgaaacacggtaccatttcattgattgaagacggtgttcctgtcttggccttgatttcaaatcatccacatcttgcaagccatactcgaggcaatattcaggaagtggtggcgcgtggtgccaatgtcttgacaattgtagatgaagcagtagctaaggaagaggatgacatcactgttacaacggttcatccattcttatcagcgattgctatggttgttccgacacagttgatcgcttactatgcgacattgcaacgcggtttggatgttgataaaccacgtaacttggctaagtctgttactgttgaataagaagataaggttcggatttcggacctttttttcaaatcaatgaaaaaacatacaaaattttgttaaatttattaaaaattctgaaaaattctttgaaattaaggatattttttgatatactagaacctaataattcttttaggagagctctatggattatgttttggaagttctgcccagtctactaaatggtgctgcagtctccttgcaagtattttttctagtattgatattatccttgccattaggagctgttttcgcttttttaatgcagattaaatttaaacccttacaatggttattgcatttctatgtattaattatgcgaggaacccccttacttttacaattaatttttgtttattacgtcttaccaagtgtgggtattacatttgaccgaatgcctgctgtgattctggcctttacgctcaactatgcggcctatttctctgaaattttccgtggtggtattgaagctattccaaaaggtcagtatgaagctgctaaggtattgaaatttacccctgttcagaccattcgctacattgtcttaccacaggttgtgaaaattgttctgccaagtgttttcaatgaagtcatgactttggtaaaggatacttctttggtctatgcacttggggttagcgatttgttgttggctagtcgtactgcggccaatcgtgatgccagcttggcacctatgtttatcgcaggtgcaatctacctattgatgatcggtgcggtaacactgatttctaaacaagtagaaaagaaatttgattattatagataggaggaagtcatgttagagttacgcaatttgtcaaaacgctttgaagataaacagattttctccaactatgatttggtcattccagaagggaaaattgttgccattgttggtcaatctggcggtggtaagacaactcttttacggatgttggctggtttagagactattgattcaggaactttgatgtataacggtcaagaactgccattagaggagttgggaaaacgacatttgctgggctttgtcttccaggacttccagcttttcccgcacctatccgtattggaaaacttggttctctctcctatgaaaacgcaaaatatgttgcgttcagaggcggaagacaaggcccttaaactcttggatactcttggacttgctaaccacgcaaatgcctacccattttcattatcgggtggacagaaacaacgtgtggccttggcgcgtgcgatgatgattgatcctgagattatcggctatgatgaaccaacttcggccctagaccctgaattaagaaaagaagttgagaaactgattcttgaaaatagggctactggaatcacgcaaattgtggtcacccatgatatgcagtttgctgagaatatcgcagatgaaatcatcaaaattgaaccgaaacactaagaaaaggaacaaatatgatgatgaatattaaaaaaatgatgcttggagctcttgctcttgtaacttctttgactcttgctgcttgtggctccaatgattcggctactaagtctgataattggacagcctacgagtctgaaaaatccgttacgattggctttgataagacctttgtcccaatgggatttgaacagacagatggttcttacacaggttttgatattgacttggctaatgcagtctttgaaaaatatggaattactgtaaaatggcaaccaattgactgggacttgaaagaaactgaattgaataacgggaatattgatttaatttggaatggttattctattacagatgagcgtaaggaaaaagttcttttcacaaatccctacatggataaccaacaagttcttgtaaccaaaaaatcttccaatattagccaagtatctgatatgaaggataagattttaggtgcgcaagcaggttcatctggctattcagtatttgaatcacaaccagctattttgaaagatattgttcaaaataacgatgcaagtcagtatgcgaccttcaatgaagccttgattgacttgaaaaacgatcgtattgatggccttttgattgaccgtgtgtatgcaaattattacttgcaacaagagggaattatcgcagattacaacatcattgatgcaggttttgaaaatgaagccttcgcagtcggtgctcgtaaatcagatacgacactcgtggaaaacattaataaggcgtttgctgaattatataaagaaggtaaattccaagaaatctcccaaaaatggtttggtgaggatgttgcaaccgacacagtaaaaaaataataatgtaagcaaaagtgactgaacaagacatccatgatggttacaccctcatccacagaataatgaaaagaactcgtgaaaacggtggggtgtacaccaatatcattaacttaagattctacgaggctgagcaaaaagctcagcgccacttctcggagttcgtgtcaacatctcagcgcagtggttgattggcttaaacagtcactattctgactgttggagctatgcgggggtgggagtttaaaaggtctgggagaccttttaaagtgggagatataagctgacggcagtcagctcacataaattgatgtctggggatagattgtttcagctcaacaacttaaaacgaaaaattgttgacgaactttttttcgtctggtcgagttcttatacgaaaactcaaaagaatgcaaaaattcccttcctatgatataatcaaagtgaaaaaaatttgtatttaggctactagttcgtccctagtagtctttttttgtgctaaaaattcaggataagtcatctgttcttttaaaaggatataggctatttttaatagttgatgcgcaagtgcaatggttgctttttgtgagccacgccgactttgaatctgataatatcgttctgctaatgggctgcctttttgtcttttgacagcgaaggccgcttgacataagcatttcttccaataggaattcccgtgtcgaatcttggtacttcgtttttcccactccctaggattttttattatatgacttttagtccatcacaatccgtaaagtatgtgacaaatgaaccgaggatgggcaaaaaatggtcctataatttctgtagcgggtaaaaccactatggagccttttaaatgtaaaagtcatatgacctataatgaaaagcgaaaaaacttacattagaaagaggtcatatggaataaatcaagagttaggggagtgactcttgattcctgagcctagaaatagaaaagcgaagatcttatcacaaattttcttggaatagaagacaaaaatatcgctatcatgactgaatatgatgtggaaactcacttagattgtgtgtctccaaaatgtcttgcctgaaagggacaaatagtgaaatacaacttccaaagagcatctaaaatcctttgcttagaagcagctgataatcctctctccttatccatcttagaaagcgtcggttcaagtgtaaaggatgcgggaaaatggttgtcgctgaaattcacttattaaaaaaacgaccaaatctctgttgctattaaccagaaaaccccccaattactactcgttgagaatcaagcaatgagtaagcaatattcacctgatactattgtcatcaaggatagcttttctatcctattcggaactataaagtaagagtttttgaagggggtagatattggttgcatgtattgaaaaacttgtggttccatggtttttaaagttactctatctggctatattttgaactatgttattacaccagtttctgattatgtagtgaattgcttgttggaaggctatcagtaatctgtgattttagcagatttagtcaggagtttaaagacaacttggaacagaaggatagaacatggaaggagttaattagtataacaaatggagattattagccatgaggcgaaccattgaaactcgttttctgaatcatacgctttgtttgatatagaacaaacctttgccagaggactgctcggattacagctacggattgaacaaatcctacttatctacaatctaagctattttgactttaactagtagcacgggtaaaaaaactgcctagttcaatcagaactgggcagtacttattttacattctaaaaaatggattgaaatttttctcatgtccaacgctggtattttgaccatgacctggatggacagtatagtgatttggcagggtaaagatatgttctctgatgccagtaatcaggtcatcaaagttgctggttggcaggtctgtgcgtcccacagtttcacggaaaagtgcgtctccagtgatgacacattcatcctctgggaagataaaggaaacaccaccaatagagtgaccaggtgttggaactaccttgaaatgaaaaccgtcaaactggtagtcttcttggtattggaagattttttcagcaggtcggcagactacattttccatatcatcatgacgaggtagacctgatagattcatctctggtgtgtagagccagctggcttcattttcagccacatagacaggcgggaaattgtaggtctcacgcaggatgtccaaactcataatatggtcatagtgagtgtgagtcaggagaatagccgaaattggttttccgattttttcgatagttacttgaatttttgtccagtcactcccagggtcaatgataatcagatgggtatcattttcaaggtagtaggtattttgaaaagcgacaggattgacagatttgtgaataatcattctttttccttcttctaacagttactgatgttactagtctaacaaaaaaacacgccttcttcatggaatttgtttggagctttttccatgagagggaatatgctataatgaacagtatgaaagacacaagaacaagcaatcggtatgccgttgtagatttggaagcaactggtacaggtaccgatgcaaaaatcattcaaatcgggattgttctcgttgaaaatggagaaatcattgacagttatgcaacggatatcaatccctatgagctactggatgaccatatcaagaatctgacaggtatcacagaccaacagctaagtcaggctccagattttggtcaggtagcaagtaccatttacgacatgattggagatgctatttttgtagcccataatgtcaaatttgatgctaatctcttggcagaagcactcttttttgaaggttatgaactgttgacaccgcgtgtagatacggtagaattatcacagctatttttcccgacttttgaaaaatatagcttgggaaaccttgcagagcatttggaacttggtttggaccaggcacacacggccatatcagatgccatggctacggcgcgcttgctcatcaaaattcaagagaaaataaagagcttacccaggtctattgttgaaaagattcttgatttggcggacaatctgctctttgaatcccgtttggtcattgatgagatggtgcctgttctgtcagaaaatctatcatacgatttagaatctattcatgacttggtcttgaaaaagccagaagaaatcaagtcagcctaccgattatctgaagatttttcgaccaatattgcccttctcggcttgcatgaacgaaaaaaacaaactgcttttgctcaagtagtagaaaaacgcttggttgacgaagaaaaagtgcattttattcaagcgcaggcaggtttggggaagacttacggttatctcttgcctttacttgctaagtcagaccagcctttattggtcaccgtaccgaccaagctccttcaagagcagattatggaaaaggaagggagcaagcttaaagagatatttcgtattcccatagtctctctaaaatcacccaagcattttatcaagttagacaactactggaaaaccctgcagaggcaggatgataatcgcctggtcaatcaattcaaaatgcaggtgcttgtctggttatgcgaaaccacgacaggtgatttggatgagcttaagcaaaaacaacgctatcaagcttactttgatgagattgcccacgatgggaaattggagcctgaaagtcttttttggggcttggatttttggcaacgattgaaccaacaagctctctctagtagactgctcattaccaaccacgcttattttctcagccatcttaaggaccaagatcctcacatggataagcgtatggtggtgattgatgaagcacaaaagtttctcttggctgctgaaaatctagcgacggcttcgcaagatttgacaagtatgttacaagtattgcaaagtaaaaaggatagagcgacggctattttggaccaacgtttgtatgagtcttgccagtttgaactcaaccactttttgagtcgttttcgtcagcatggtcaacgagaggttcaaaaggctgaacttcaccaacttggtcagaacctggaggagcttggagatgttgatttgaacgacttgcatcagctcatagactattacgataccttttggttggaggagaaaaatttagaagaaaagcggcttgcctatttgcggagctccaaggatagcctcctaaatgcgaccaactatctgccagatactaagattttctgcatcagcgccaccttgaccatcagcaaaaaggtcagtctggcggatctgctgggctttgagcaggtcaccttggatttgataccgactcaaactgtgaccaaccagcggctactttttccgacccatctccccgacatcctcgcttggaccaaggaggagcatgcagcatatttggctactactttaggagagatagcagagctgggacgaccgattttggtcttgtttacatcgatttctatgctcttgcaggtgtcggatttgttagaagacaataacattccccacctagcccagcacaagcatggacaggaaatgactctcaaacgcaaatttgaacgaggggaatgccaaattttactcggcacaggtgtattctgggagggcgttgactttgccagtcagaatcaattgattcaggttattacaaggctcccatttgacaatccaaaggaccggtttgtacaaaaaatcaatcaccatctgcgtgaagaagggaaaaatccattttatgattacagcctgcctatgatgatgattaagctcaaacaagccatcggtcgtaccaatcgccatgacaaacaagattcactagtcttggttttggacccgcgtgttcacaccaaacgctatggacagcaaattctgtccttctttgagaaagattatttaatgttaagtgtggatgcgaaagaaatagaaggagctattcaagatttttttgaataagttgaaagggagccacaaggcttccttttgtttccagcgttttttaatgcactcatgattaggaatctattccctctctccttgccgaataacagtgattttctttatgattaaaatatggtataattttccaaatattagtttttgtgagaagagattatgacagaaaaaacaattgtatttaaggtcgggacaagttctctgacgcaagaaaatggcagtctggaccgtatcaagatcgctcggattaccaatcagctggctcagttgcaccagaaaggttaccagattgtgctggtgacgtcgggctcgattgctgctggttttcggagattgggatttgacaagcgaccgaccaagattgcggagaagcaggcttctgcggccgttggacaaggtttgctgattgaggaatatacgcaaaatctaatgaaggacggcatcgtatcggctcagattttactgacccaggatgattttgcggatgccagacgttatcagaatgcctctcaagccttgcaggtcttgctcaagcaacgggctattcctattataaatgaaaatgataccattgccattgaggagattaaggtgggggataacgatactttatctgctcaggtggcttctctcttgaaagcagacctattggtgctcttgacggatgtggatggactttacactgccaatcctaacagcgatccgactgcccagcacttgcctcaaattaaggagattacggaagatttatttgccatggcagcaggagcaggctcgtccaatggaacaggtggcatgaccaccaaattgcaggcggcccagattgcgaccaagtcaggcgtgcccgtctttatctgctcttcaaaagaggataccgccctcttgcaggcggtcacccaagccaatcgtggaacgctctttttagcagatgaccatgccatgaaccaacgcaagcagtggatggccttctatgctcggacagacgcggcggttgaagtggatgcaggagcggttgatgctatgttgcaccagggccgcagtttgttagctactggtgtcaaagccctcgaaggagactttgaagtgggccaggtcgtagaagtttacagccaagcagaccatcgtttgattggtaaaggtcgggtcaaactgtcctccaaggacttgcaggaccagttggcaaatggcagagcagagggcgtgttgattcaccgcaacgattgggtgagcttatagttgttcagtttgtctcgattatgttgacgaacgagtaaactgaaagactaaataggagaaatttatgacaacaacacaagtattattagatagtttattggccaacaaggcttctatcaacctagcgacaacagaacagaaaaaccaggctctatcagcaatggcagaccagttggttgctcagactgaggcaattttagcaggcaatgccatcgacatggaacatgcccaaggcaagattagccaggtgatgcaggaccgtttgctgctgacagaggaacggattgaagctatggcagatggcattcgtgccttgattggcttgccagatcctgtcggattagtcttggaagaatccactcgggcagacggcttgaacatttgcaagaaatccattccctttggtttggtgggaatgatttacgaaagccgaccaaacgtgacttcagatgccgctgccttggccatcaagagtggtaatgcggtcatcttgcgtggtggcaaggaagcttttcattcggccaaagcgattgtcacagcactcaagagtggcttggaagaagctggtgtctcaccaaaggtcatcgagttagtccaagataccagccgggtctctgcgacggagttgatgaccgcaaaaggcaagattgatttattggtgccacgtggtggagcaggactcattcaagccgtagtagaaaatgcgactgtgccagttattgaaacaggaacaggtatctgccatgtctatgtggacaaggatgcggacttggacaaggccttgcggattgtggtcaatgccaaaaccagtcgtccctcagtctgcaatgcggcggaagtcttgttggtccatgaagaaattgccagccaattcctacctcgcttggaagaagctctttctggtcaggtggaattacgtgccgacagtcaggcccaggctctcctcaaccaagccagaccagcaggcgaccaagattttgacacagaatttttggactatatcatggcggtcaaggtcgtttcaagtgtagaagaggctatcagccatatcgcccaacattcgactggacatagcgaggcgattgtgacggaaaacagccagacagcagagcattttacactccatgtggactcggcagcagtctatgtcaatgcctcgacccgctttacagacggtggagagttcggtctgggctgtgagctgggtatttccacccagaagatgcacgcccgtggtccaatgggactgcgtgaaatgaccacttacaagtacatcatcacaggcgacggccacattcgttaggaggacaagatgaagattggatttattggactgggcaatatgggagcggccctagcccaagcggtcagccagcagccagatacccagctcctcctcagcaaccataacccagcaaaagcccaggctcttcaagagaaggtaggcggtcagcttttttctaatggacaaatagcagagcaggccgagattattttccttggggtcaagcctcacctgattcagacagtcttgtcaggcttgcaggaccagattagccagaatccgtcagctatctggatttccatggcagcaggagtgccccttgacagcctggcagcatttgtatcggcagataaagttatccgtatcatgcccaatacaccagtcgctatcggccaaggcatgacaacctatagcctggtcaatcaaaatctcgctccgctattggaacaaatcctagaaaaatcaggcaaggtccagcaagtgccagagagcctaatcgacgcagcaacggctatcgcaggctgcggaccagcctttgtctatcagatgattgaggctctgacagatgcaggggtgcaaaacgggctgacggcccaggatgccaaggtattggcggctcagaccctggcaggaactgctcagatggtcttaaccagcgataaacacccagcccagctgagacaggaagtgacctcgccaggcggctcgactatcgcaggtgtggtagctcttgaaaaagaaggcttccgttacgccattatcaaggcagtcgccgccgccctcaaaaagactagaaaattaggcaaaaaatagaagacagcaaaaaacgggacttttaatcccgttttgttttttccttgatccattgactgacgttggacagggccttgctttgctctgccttgcgtttttgttcctggacaaaatctgcaaagctttgcttgacgccgtccttttgaaccttgtcctgcaaatcatgccatttctttttaaggttgctggaagtccgttcgtagtagtcttcaaggatttcttccttggacttgtaattgcggtagaaggcattgcgtgacacaccagcttttcggaccaattcagataccgaaatttgcttgagctcctttttctctaggagaaatagcagagcagtttctattgattccttagtcagttgattcgcttctttatttgattgatagaggtttttcaaagattggggtgaaattttacgacctgccatagttttccttttccgagtgtcacatctgaaagaaaatgctttcagatggggtagtttaatgatataattgtaagtaaatagagatttattgtcaaataaaaaaaataaaattggaaatgagaatattatgacaaaatggaaaatcgttgcagattcgggctgcgactatcgtcaattagctaatctagctccggacactgaatttattagtgtgccacttaccatccaagttggagaacaagcatttgttgatgatgcaagcttggatattgatcacatgatggaggtgatggaagcatctaagtctgcagcggggtcggcgtgcccaagtccgcaggcttatcaggcagcttttgagggagctgagaacattatcgttgtgacgattacaggtgggctatcgggtagttttaatgcggcacgtgtagctagggatatgtatatcgaagagcatccgaatgtcaatatccatttgatagatagtttgtcagccagtggggaaatggatttacttgtagacgaaatcaatcgcttaattagtgcaggattagattttccacaagtagtagaagcgataactcactatcgggaacacagtaagctcctctttgttttagcgaaagttgataatcttgttaagaatggaagactgagcaaattggtaggcactgtcgttggtcttctcaatatccgtatggttggtgaggcaagtgctgaaggaaaattagagttgcttcaaaaggcgcgtggtcataagaaatctgtgacagcagcctttgaagaaatgaaaaaagcaggctatgatggtggtcgaattgttatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctacgaagtgaaagcgtgattcacagagtaataattttgggctgtaatttccgctatagaataatccccctcgtcttctaagttcgagggggattgtttgtatgagactattggatttcattcattcaaatatcttacgaattgctccagtttatctgcaaaatcttgttcaaagaagatctgtaagaaatcagctttctgtccgctgaaataataacattttccaaacatgtgttggatgctaggagaaagaatccccttgcttagctgaaaggtcacgctccctttggaaattcgatacgggatgtttaaagcgtatttctctagacagtcttttattttattccattgagcgtgataaatgtgatgaagatgctgtgtgttccgcgcaaacataccgttatcaatgtagagcgagagagctttttgcatgataagattggtatcgtagtcgattagactcttatgtttgatgaagatatcacgtagctgattaggaaggctgattgcaccgattcggagggcaggaaagagtgtcggtgtaaaagattttatatagatgacgcgattatctgtatcaagatagtgtaaaggtaggctatgactagagtcgaaatctgctaaatagtcatcctcaatgatgtagacatcgtattgctttgctaattttacgatggctgtttttgttgctatatcataggttgaaccgagagggttgtgcaagcgaggaattgtgtagaaaaacttaatttttccagtttggaagatactttccaattcttctaggtcaattccatctaaattccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagctggtctttttttgtatagacatgatagtccattaacagactttgaacggaggaaatcaattctgccaatccctcttgctggtgatagtagttgaataggtaattttcccgcccaataagactttcttttagacaaatccgaaaatcttcatagggtaattcttgaaagtctgtaggattgagctctacagtatggtcttggaaatctctatcctctaagatataataaccgcttttttcgacagcgtagatcttattttggtattttaattccaacatagccttttggacagtgtctttgctacaatgatattgctcgcggagttgacggatagaaggtaatttctctccacgtttgaatcgatgttcctctattccagtcaaaatatcttggatgataacttgatattttttcatctaggtccccttttttatagactatgttactagctagtatatagaaaaaattgaagaaagacaatatatgaataatggggttgaggttcaggaattaagctactctatggtataattaagtgatgaaaataattatacctaatgcaaaagaagtaaatacaaatctagagaatgcctcgttttatctcctgtctgatcgaagcaagccggtgctggatgccataagtcaatttgatgtaaaaaagatggctgccttttataaattgaatgaagcaaaggctgagttagaagctgaccgttggtatcgaatcaggacaggtcaagcaaaaacctatccagcctggcagttatatgatggtctcatgtatcgttatatggataggcgaggtatagattcgaaagaagaaaattatctacgtgaccacgttcgtgtagcgacagccttatacggattgattcatccttttgaattcatttcacctcaccgcttagattttcaagggagcttaaagataggcaatcagtctttgaaacagtactggcgaccgtattatgaccaagaagttggtgatgatgaactgattctctcactggcttcgtcagaatttgagcaggtgttttctccacagattcagaaaagattagttaaaattcttttcatggaagaaaaagcaggtcagctaaaagttcactcgactatatcaaaaaaaggcagaggaagattgctgtcctggttggctaagaacaatattcaggaattatcggacattcaagattttaaggtggatggctttgaatattgtacttccgaatcaacggcaaaccaacttaccttcatacgatcaataaaaatgtgaaattatgaaaaagataacgttttccagcgctaaaaagggtagaaaaatattaatttctatgatataatggatgcgttataggtaaaagtctaggaaggttgtttatgaaaaagagaagcggacgaagtaagtcgtccaagttcaaattggtaaattttgcgcttttgggactttattccattactctatgtttgttcttagtgaccatgtatcgctataacatcctagatttccggtatttaaactatattgtgacgcttttgctagtaggagtggcagtattggctggattattgatgtggcgtaagaaagcgcgcatatttacagcgctcttacttgttttttcactggtcatcacgtctgttgggatctatggaatgcaagaagttgtaaaattttcaacacgactaaattcaaattcgacattttcagaatatgaaatgagtatccttgtcccagcaaatagtgatattacggacgttcgtcagcttactagtatccttgctccagccgaatacgaccaagataacatcaccgctttattggatgacatatccaaaatggaatctactcaactagcaactagccccgcgacctcttacctgacagcatatcaatctatgttgaatggcgagagtcaagcgatggtgttcaacggagtttttaccaatattttagaaaatgaagatccaggcttttcttcaaaagtgaaaaaaatatatagtttcaaagtgactcagactgttgaaacagctactaagcaggtgagtggagatagctttaatatctatattagtggtattgatgcttatggaccgatttctacggtctctcgttcagatgtcaatatcattatgactgtcaatcgtgcgacacataagattttattgacaactactccacgagattcatacgttgctatcgcagatggcgggcaaaatcaatacgataaactaacacatgctggtatctacggtgtcaatgcttctgtgcacaccttagaaaatctctatgggattgacattagcaattatgtgcggttgaacttcatttccttccttcaattaatcgacttggtgggtggaattgatgtatataacgatcaagaatttacaagtttacatgggaattatcatttccctgttggacaagttcatttaaactcagaccaagcattaggcttcgttcgagagcgctactctttaacagggggtgacaatgaccgtggtaaaaaccaggaaaaagtgattgctgccttgattaaaaagatgagtacgccagagaatctaaaaaattaccaggcaatcctatctggattggaaggctcaattcaaacggatttgagcttagaaacgattatgagtttagtgaatacccaactagaatcaggaacacaatttacagtagagtcacaagcattgacaggaacaggacgctcagacttatcttcttatgcgatgcctggatcacaactttatatgatggaaattaaccaagatagtctggagcaatcaaaggcagcgattcagtccgtacttgttgaaaaataaagattttaggagaaaatatgaacaatcaagaagtaaatgcaatcgaaatcgatgttttattcttactaaaaacaatttggagaaagaaatttttaattctcttaactgcagtgttgactgcggggttggcatttgtctacagtagttttttagtgacacctcaatatgactccactacccgtatctatgtagtgagtcaaaatgttgaagccggtgcgggcttgactaaccaagagttacaagcgggtacctatttggcaaaagactatcgggaaattatcctatcacaagatgtattgacacaagtagcaacggaattgaatctgaaagagagtttgaaagaaaaaatatcagtttctattcctgttgatactcgtatcgtttctatttctgtgcgtgatgcggatccaaatgaagcggcacgtattgcaaatagccttcgcacctttgcagtgcaaaaggttgttgaggtcaccaaggtaagcgatgtgacgacacttgaagaagcagtcccagcggaagaaccaaccactccaaatacaaaacgaaatatcttgcttggtttattagctggaggtatcttggcaacaggtcttgtactggttatggaggttttggatgaccgtgtaaaacgtcctcaggacatcgaagaggtaatgggattgacattgctaggtatagtaccagattcgaagaaattaaaataggagaacaatatggcgatgttagaaattgcacgtacaaaaagagagggagtaaataaaaccgaggagtatttcaatgctatccgtaccaatattcagcttagcggagcagatattaaggttgttggtattacctctgttaaatcgaatgaaggtaagagtacaactgcggctagtctcgctattgcctatgctcgttcaggttataagaccgtcttggtggatgcagatatccgaaattcagtcatgcctggtttcttcaagccaattacaaagattacaggtttgacggattacctagcagggacaacagacttgtctcaaggattatgcgatacagatattccaaacttgaccgtaattgagtcaggaaaggtttctcccaaccctactgcccttttacaaagtaagaattttgaaaatctacttgcgactcttcgtcgctattatgattatgttatcgttgactgtccaccattaggactggtagttgatgcagctatcattgcacaaaaatgtgatgcgatggttgcagtagtagaagcaggcaatgttaagtgctcatctttgaaaaaagtaaaagagcagttggaaaaaacaggcacaccgttcttaggcgttatcttgaacaaatatgatattgccactgagaagtatagtgaatacggaaattacggcaaaaaagcctaatttctcagataacataagtttgataagtaggtattaatatgattgatatccattcgcatatcatatttggtgtggatgacggtcccaaaactattgaagagagcctgagtttgataagcgaagcttatcgtcaaggtgttcgctatatcgtagcgacatctcatagacgaaaagggatgtttgaaacaccagaaaaaatcatcatgattaactttcttcaacttaaagaggcagtagcagaagtttatcctgaaatacgattgtgctatggtgctgaattgtattatagtaaagatatcttaagcaaacttgaaaaaaagaaagtaccaacacttaatggctcgtgctatattctcttggagttcagtacggatactccttggaaagagattcaagaagcagtgaacgaaatgacgctacttgggctaactcccgtacttgcccatatagagcgttatgatgctctggcatttcagtcagagagagtagaaaagctaattgacaagggatgctacactcaggtaaatagtaaccatgtgttgaagcctgctttaattggcgaacgagcaaaagaatttaaaaaacgtactcgatattttttagagcaggatttagtacattgtgttgctagcgatatgcataatttatatagtagacctccgtttatgagggaggcgtatcagcttgtaaaaaaagagtatggtgaggatagagcgaaggctttgttcaagaaaaatcctttgttgatattgaaaaatcaagtacagtaacctcatagaaatagtggaggagctatgaatattgaaataggatatcgccaaacgaaattggcattgtttgatatgatagcagttacgatttctgcaatcttaacaagtcatataccaaatgctgatttaaatcgttctggaatttttatcataatgatggttcattattttgcattttttatatctcgtatgccggttgaatttgagtatagaggtaatctgatagagtttgaaaaaacatttaactatagtataatatttgtaatttttcttatggcagtttcatttatgttagagaataatttcgcactttcaagacgtggtgccgtgtatttcacattaataaacttcgttttggtatacctatttaacgtaattattaagcagtttaaggatagctttctattttcgacaacctatcaaaaaaagacgattctaattacaacggctgaactatgggaaaatatgcaagttttatttgaatcagatatactatttcaaaaaaatcttgttgcattggtaattttaggtacagaaatagataaaattaatttaccattaccgctctattattctgttgaagaagctatagagttttcaacaagggaagtggtcgactacgtctttataaatttaccaagtgaatattttgacttaaagcaattagtttcagactttgagttgttaggtattgatgtaggcgttgatattaattcattcggttttactgtgttgaagaataaaaaaatccaaatgctaggtgaccatagcatcgtcactttttccacaaatttttataagcctagtcacatcttgatgaaacgacttttagatatacttggagcagtagtcgggttaattatttgtggtatagtttctattttgttaattccaattattcgtagagatggtggaccagccatttttgctcagaaacgagttggacagaatggacgcatatttacattctacaagtttcgttcgatgtttgttgatgccgaggtacgtaagaaagaattaatggctcaaaaccagatgcaaggtgggatgttcaaaatggacaacgatcctagaattactccaattggacacttcatacgaaaaacaagtttagatgagttaccacaattttataatgttctaattggagatatgagtctagtcggtacccgtccgcctacagttgatgaatttgaaaaatatactcctagtcaaaagagaagattgagttttaaaccagggattacaggtctttggcaagtgagcggaagaagtgatatcacagattttaatgaagtcgttaggctggacctaacatacattgataattggaccatctggtcagacattaagattttattgaagacagtgaaagttgtattgttgagagagggaagtaagtaagactcctttaaaacaaagaatagtagtaggggatatgagaacagtttatattattggttcaaaaggaataccagcaaagtatggtggtttcgagactttcgtagaaaaattaactgagtatcagaaagataaatcaattaattattttgttgcatgtacaagagaaaattcagcaaaatcagatattacaggagaagtttttgaacataatggagcaacatgttttaatattgatgtgccaaatattggttcagcaaaagccattctttatgatattatggctctcaagaaatctattgaaattgccaaagatagaaatgatacctctccaattttctacattcttgcttgtcggattggtcctttcatttatctttttaagaagcagattgaatcaattggaggtcaacttttcgtaaacccagacggtcatgaatggctacgtgaaaagtggagttatcccgtccgacagtattggaaattttctgagagtttgatgttaaaatacgctgatttactaatttgtgatagcaaaaatattgaaaaatatattcatgaagattatcgaaaatatgctcctgaaacatcttatattgcttatggaacagacttagataaatcacgcctttctccgacagatagtgtagtacgtgagtggtataaggagaaggaaatttcagaaaatgattactatttggttgttggacgatttgtgcctgaaaataactatgaagtaatgattcgagagtttatgaaatcatattcaagaaaagattttgttttgataacgaatgtagagcataattccttttatgagaaattgaaaaaagaaacagggttcgataaagataagcgtataaagtttgttggaacagtctataatcaggagctgttaaaatatattcgtgaaaatgcatttgcttattttcatggtcacgaggttggaggaacgaacccatctttacttgaagcactttcttctactaaactaaatcttcttctagatgtgggctttaatagagaagtaggggaagaaggagcgaaatactggaataaagataatcttcacagagttattgacagttgtgagcaattatcacaagaacaaattaatgatatggatagtttatcaacaaaacaagtcaaagaaagattttcttgggattttattgttgatgagtatgagaagttgtttaaaggataagttatgaaaaagattctatatctccatgctggagcagaattatatggggcagataaggttctcttggaacttataaaaggcttagataagaatgaatttgaagcgcatgttatcctacctaatgatggagtcctagtgccagcattaagagaagttggtgcgcaagttgaagttattaactatccaattctacgtaggaaatattttaatccaaaagggatttttgactacttcatatcatatcatcactattctaaacagattgctcaatatgccatagaaaataaggttgacataattcacaataatactaccgctgtcttagaaggcatttatctgaagcgaaaactcaaattacctttgttgtggcatgttcatgagattattgtcaaacctaaattcatctctgattcgatcaattttttaatggggcgttttgctgataagattgtgacagtttcacaggctgtggcaaaccatataaaacaatcacctcatatcaaagatgaccaaatcagtgtaatctacaatggggtagataataaagtgtattatcagtccgatgctcggtctgttcgagaaagatttgacattgacgaagaggctcttgtcattggtatggtcggtcgagtcaatgcgtggaaaggacaaggagattttttagaagcagttgctcctatactcgaacagaatccaaaagctatcgcctttatagcaggaagtgcttttgaaggagaagagtggcgagtagtagaattagaaaagaagatttctcaattaaaggtctcttctcaagtcagacgaattgattattatgcaaataccactgaattatataatatgtttgatatttttgtacttccaagtactaatccagaccctctaccaacggttgtactagaagcaatggcatgcggtaaacctgttgtcggttaccgacatggtggtgtttgtgagatggtgaaagaaggtgttaacggtttcttagtcactccgaactcaccgttaaatttatcaaaagtaattcttcagttatcggaaaatataaatctcagaaaaaaaattggtaataattctatagaacgtcaaaaagaacatttttcgttaaaaagctatgtaaaaaatttttcgaaagtctacacctccctcaaagtatactgattggctgaagtgaatgctttagtatagcgatttatcgtattatcattcgataaaacaaatgttcagaaacagttataagttatttctaaagggcacctctataaactcccaaaattgcgaatttggagttacgaaagccttgttaaatcaacattttaaattttagaaaattagtttttagagctcccctaaaatagaagataacagaagggagccttcaaaaacttcatttttaattggattgtagaaaaactgttaaatcaatatttagatttttaggagttcagtttttggggggagagcttaataatctatgcactatatttcgaaaaatatatggtgtaaaatcagaactgatggtcgtggcaaaaaagagaatgaggaatttatgaaaattatttcttttacaatggttaataacgaaagtgagataatagagtcatttatacggtataattataactttattgacgagatggtcattattgataatggttgtacagataacacgatgcaaattatttttaatttgattaaagagggatataaaatatccgtatatgatgagtctttagaggcatataatcagtatcgacttgataataaatatctaacgaaaataattgctgaaaaaaatccagatttgataatacctttggatgcggatgaatttttaacagccgattcaaatccacggaaacttttggaacaactggacttagaaaagatacattatgtgaattggcaatggtttgttatgactaaaaaagatgatattaatgaatcgtttataccacgtagaatgcaatattgttttgaaaaacctgtttggcatcattctgatggtaaaccagttactaaatgtataatttccgctaagtattacaaaaaaatgaatttaaagctatcgatgggacatcacactgtttttggtaacccaaatgtaaggatagaacatcataatgatttgaaatttgcacattatcgagctattagccaagagcaattaatttataaaacaatttgttacactattcgcgatattgctactatggagaacaatatcgaaacagctcaaagaacaaatcagatggcgctcattgaatctggcgtggatatgtgggaaacggcgagagaagcctcttattcaggttatgattgtaatgttatacatgcaccaattgatttaagtttttgtaaagaaaatattgtaataaaatataacgaactatccagagaaacagtagcagaacgcgtgatgaaaacgggaagagaaatggctgttcgtgcatataatgtggagcgaaaacaaaaagaaaagaaatttctaaaacctattatatttgtattagatgggttaaaaggagatgagtatattcatcccaatccatcaaatcatttgacgatcttaactgaaatgtataacgtcagaggcttacttaccgataatcaccaaattaaatttctcaaagttaattatagattaattataactccagattttgctaagtttttaccgcatgaatttattgttgtaccagataccttggatatagagcaagttaaaagccagtatgttggtacaggtgtagacttgtcaaagattatttctttaaaagagtatcgaaaagagataggctttattggtaatttgtatgcgcttttaggatttgttccgaatatgctcaatagaatttatctatatattcagagaaacggtattgcaaacactattataaaaatcaagtcgagattgtgagagttgtttacttttatttgtaattttaaaagtaatgcaggcagataggagaaaaacgtttggaaaaatgagaataagaattaataatttgttttttgttgccatagcgtttatgggcataattattagtaattcgcaagttgttctagcgataggcaaagcttctgtgattcagtatctatcttatttagttttgattttatgtatagttaatgatttattaaaaaataacaaacatattgtagtttataaattagggtatttgtttcttattatatttttatttactatcggaatatgtcagcaaattcttcctataacaactaaaatatatttatcaatttcaatgatgattatttcagttttagcaacgttgccaataagtttgataaaagatattgatgattttagacggatttcaaatcatttgttattcgctctttttataacttcgatattaggaataatgatgggggcaacgatgttcacgggggcagtagaaggtatcggttttagtcagggttttaatggaggattgacgcataagaacttttttggaataactattttaatggggttcgtattaacttacttggcgtataagtatggttcctataaaagaacggatcgttttattttaggattagaattgtttttgattcttatttcaaacacacgctcagtttatttaatactattgctttttctatttcttgttaatcttgacaaaatcaaaatagaacaaagacaatggagtacgcttaaatatatttccatgctattttgtgctatttttttatactatttctttggttttttaataacacatagtgattcttacgctcatcgcgttaatggtcttattaatttttttgagtattatagaaatgattggttccatctaatgtttggtgcagcggatttggcatatggggatttaactttagactatgctataagggttagacgcgttttaggttggaatggaacgcttgaaatgcccttactgagtattatgttaaaaaatggttttatcggtctggtagggtatgggattgttttatataaactttatcgtaatgtaagaatattaaaaacagataatataaaaacaataggaaagtctgtatttatcattgtagtcctatctgcaacagtagaaaattatattgtaaatttaagttttgtatttatgccaatatgtttttgtttattaaattctatatctactatggaatcaactattaacaaacaactgcaaacataaattggcaggaatagagttttgagttgctattaatttggtagagcatatgttctataggtggcaagatagaagatagtattttttacatgatgatttttatgatagcaaagcaagttacggcataaaaggaattagaggatggaaaaagtcagcattattgtacctatttttaatacggaaaagtacttaagagagtgtttagatagcattatttcccaatcgtatactaatctagagattcttttgatagatgacggttcttcagattcatcaacggatatatgtttggaatacgcagagcaagatggtagaataaaacttttccggttaccaaatggtggtgtttcaaacgcaaggaattacggtatcaaaaatagcacagcaaattatattatgtttgtagattctgatgatattgttgacggcaacattgttgagtccttatacacctgtttaaaagagaatgatagtgatttgtcgggagggttacttgctacttttgatggaaattatcaagaatctgagctgcaaaagtgtcaaattgatttggaagagataaaagaggtgcgagacttaggaaatgaaaattttccaaatcattatatgagcggtatctttaatagcccttgttgcaaactttataagaatatatatataaacaaaggttttgacactgaacagtggttaggagaggacttattatttaatctaaattatttaaagaatataaaaaaagtcagctatgtaaacagaaatctttattttgctagaagaggtatacaaagtactacaaatacgtttaaaaaagatgtttttattcaattagaaaatttagaagaaaaaacttttgatttgtttgttaaaatatttggtggacaatatgaattttctgtttttaaagagacgctacagtggcatattatttattatagcttattaatgttcaaaaatggagatgaatcgcttccaaagaaattgcatatatttaagtatttatacaataggcattctttagatactctaagtattaaacgaacgtcctctgtttttaaaagaatatgtaaattaattgttgctaataatttgtttaaaatttttttaaatactttaattagggaagaaaaaaataatgattaacatttctatcatcgtcccaatttacaatgttgaacaatatctatccaagtgtataaatagcattgtaaatcagacctacaaacatatagagattcttctggtgaatgacggtagtacggataattcggaagaaatttgtttagcatatgcgaagaaagatagtcgcattcgttattttaaaaaagagaacggcgggctatcagatgcccgtaattatggcataagtcgcgccaagggtgactacttagcttttatagactcagatgattttattcattcggagttcatccaacgtttacacgaagcaattgagagagagaatgcccttgtggcagttgctggttatgatagggtagatgcttcggggcatttcttaacagcagagccgcttcctacaaatcaggctgttctgagcggcaggaatgtttgtaaaaagctgctagaggcggatggtcatcgctttgtggtggcctggaataaactctataaaaaagaactatttgaagattttcgatttgaaaagggtaagattcatgaagatgaatacttcacttatcgcttgctctatgagttagaaaaagttgcaatagttaaggagtgcttgtactattatgttgaccgagaaaatagtatcataacttctagtatgactgaccatcgcttccattgcctactggaatttcaaaatgaacgaatggacttctatgaaagtagaggagataaagagctcttactagagtgttatcgttcatttttagcctttgctgttttgtttttaggcaaatataatcattggttgagcaaacagcaaaagaagcttctccaaacgctatttagaattgtatataaacaattgaagcaaaataagcgacttgctttactaatgaatgcttattatttggtagggtgtcttcatcttaattttagtgtctttctgaaaacggggaaagataaaattcaagaaagattgagaagaagtgaaagtagtactcggtaagaatgttgtaataaatggttgaaagaaaaggggattaaaatgaatccaacaaatagtagaatagcactctttgatacgattaaatgtatcatggtactttgtgttatttttacacatctggattggtctgttgagcagcgtcaatggtttatctttccgtatttcgttgacatggctgttccaatttttctgttgctttctgcctattttcgaacgaataagtggaatacaaaacaagagacgctaaagctcaagttcagcagtggtataaaagaaagtataaacatgctttgtctctatgctatcgtgatggctgttaatgttttattgagctattcgagaaccatctgataggagtaaagcctttttcaggttcttcatcgctccgttcatttgtcctgtggctactttctggagaatcgggtccagggagttgggagttactatgttccgttgttgattcaggtagtttttttattaccaattttgtatgttcttttcgagaaaaataaatggttgggcttgcttacttgttttttagtaaacttttcagtggatgccatatttgctaacatggctgaacacggcatatatatatagactaatatcacttcgttatctttttgttctagggcttggttttttctttcaaagcaggatgtgcgttccaaggtagatactttcattgcgaccctatttgggattattggagcaattctgatttttgtgaatcattctatagagcccttctcctggttttatggttggaagtctacttcctttctatgcgtcccatttgcgtatgctatgctattttttatgataaagtatggacagaagattccagcaatactgttgtcaaaattgggagttgcttcttatcatatctacttgacccagatgctgtatttttcagtagtcgcaccatttttagcagtgcaatttaaggtatcttcgttgaatttgtggaacggcttgtttacctttctaatttgcctgtttggtggctatattttctacaaagtggatctgtttatgagagtacgtggaaaacgataatgactcatttcagattagcagatgccatttcgtttattagcagattcgcatgttaatattccgacaaagaaattcaaataggttgacgagagaggagtggtatctgtttctaaaccccagtatccccctttattttcaaagctatatttattaactgaacaaggagaatttttaagagaactgtttgtttaatcccagcacgatctggttcgaaaggcttaccgaataaaaacatgctatttttggacgggaaacccatgatttttcacacgattgatgtggcaattgaatcaggttgttttgagaaagaagacatctatgtcagtacggattcagaaatgtataaggggggcacctctataaattcccaaaattgcgaatttggagttacgaaagccttgttaaatcaacatcttaaattttagaaaattagtttttagaggtccccaaggggatttgcgagacaagaggcatcaatgtattgttaagacccaaagaactatctacttatcatactccatcgaatgaagtcagtacgcacttttttacgaatctggattttatgaagattgtatatttgttcttctgcaagtcacctcaccgttacggactggcgaacagataaaagaagccatgaatatgtacttacagggggactcagaaaatgttttgcatttcaatgatgaagggcaagaaagagtgaatcagtacattatcgaagctgtacaggggttataaaaaggggttacttatccttaaagtctgtatgtagaaggagaaaaattgagacgaatttatatttgccatacgatgtatcagatcctgatttccttgttaaagatggacgttgagagagatagtttgatgtccgttgatatcatcgggcattttccagatgtcagggagcaactgcagcagcatgttcatctaatcgaggagacggagcgttcatttgatctatattctttgatagctagatcaaaaacaaaagaacgcctttccttgttacagagctatgacgaggtgatcatttttcaagatcaccgtcaagtcggtcattttttaaataaacatcggattccctattctcttttggaggatggttataattttttcaaggataaaagagtgtgcgatttggagtcaattcaatcatctgtctggaaaagactcttttatcaatggtattttaaaccaacatatttgattggttcaagtctctattgtcaatccattgaggtcaatgatctgtcgctcgtacaatttgacgaggcttataaaccctttgtagaagttccgagaaagcaattatttgatcaagcatcgccagagaaggtgcaagcgctgctgcagatatttggagcaagggcgatagtagcggatgaagagtcttctcaaaaacgattgctattattgacccagcccttgtcttgggattatcatgtgaccgaagaggagttgttggagatttatgtagcaggtcttgccccttatcgggaagactatacaatctacataaaaccgcacccacgagatggggttgattattcatttctgggtaaggctgtggtgcttctgcctcaaggtattccgtttgagttgttcgaaatggcaggtagtatccgttttgatatcggtatgacctatagttcgtctgctttagattttttaaattgttttgaagagaaagtgtatttaaaggacacttttcctcttctttcaaaaaatgatattttgcgtgaggggatagaataggaggattcatgtctaaaaaatcaatagttgtctcaggtctcgtctatacgattggaaccatcctcgttcagggattagccttcattaccctccccatctatactcgtgtcatttctcaggaagtatatgggcagtttagcttgtataattcgtgggtggggctagttggtctctttatcggtctacagttaggtggggcttttggcccgggatgggtacacttccgcgagaaatttgatgatttcgtatccaccttgatggtctcttctatcgctttctttttaccaatttttgggctatcttttctcctcagtcagcccctatcgctcctatttggtttgcctgattgggtcgttccgcttatctttttgcaaagttttatgagtgttgtgcaaggattttttacgacctatttagtgcagcggcagcagtccatgtggactttactcctatcggtactgagcgctgttatcaacactgctttatctttatttctcatcttttcgatggagaatgatttcatcgctcgtgtaatggcaaactcggcaacgactggtgtttttgcttgtgtgtccttgttgtttttctataagaagattgggcttcattttcgaaaggactatcttcggtatggtttaagtatatcgattcctcttatttttcatggattaggtcataatgtactcaatcaatttgacagaatcatgctcggcaagatgctaacactgtcagatgtagccctatacagtttcggctacacacttgcgtctatcttacaaattgtgttttcgagcttgaatacggtatggtgtccgtggtattttgagaaaaagagaggtgcagataaagatttgctcagttatgtccgttactatctggcgattggcctgtttgtgacttttggatttctaacaatttaccctgaattagcgatgttgttaggtggatctgagtatcgtttcagtatgggatttattcccatgattattgtcggggtgttctttgtatttctttatagttttccagccaatatccagttttatagtggaaatacaaagtttttgccaattggtacttttatagcaggtgtactaaatatttcagtcaactttgttttgataccgacgataggaatttatggtgctgctttggcaacgactgcttcctatctgttgttgctagtcttgcattattttgttgctaagaaaaagtatgcttacgatgaagttgcgatttcaacatttgttaaggtaattgctcttgttgtcgtctatacaggcttgatgacagtatttgtcggttcaatctggattcgttggtcactaggaatagcggttctagtcgtttatgcctacatttttagaaaggaattaacagttgccctcaatacattcagggaaaaacggtctaaataagggcacctctataaactcccaaaattgcgaatttggagttacgaaagccttgttaaatcaaacattttaaattttagaaaattagtttttagaggtccccatataaaaacgtcccaaatgagaggtgctcataagaattgaccatcactgccatctacccaaagttcaagtattctctaccatgaaaattgtgctataatcaagtataaagaagggaatgtttcttaaaggacgtatgcgcctctgcttatgccagaagtcatgaggtaaatctccctaaaaattgggtagaaaagcagattaaacttccaccaatctattgaagatcgtgtgaagaagcaggctttagaagcaacaagccctgagactattcgaaagaaatctagggctattttttctaatcggctatcagaagtgaagtagcgatctttattagtgttcttttactacttaaggaaaaccaagctgctccctcaagactttatgggagcgatttacagtcatttttagaaaggaaataaaatggtttatattattgcagaaattggttgtaatcacaacggtgatgttcatctagcacggaaaatggtagaagttgccgttgattgtggtgtggatgccgttaaatttcagacatttaaggcagatttgttgatttcaaaatacgcaccaaaggcagaataccaaaaaattacaacaggagagtcagattctcagctcgaaatgactcgtcgtttggaattgagctttgaagagtatcttgatttgcgtgattactgtcttgaaaagggagttgatgtgttttcgacaccttttgatgaggaatcattggacttcttgattagcacagatatgcccgtttataagattccatctggtgagattaccaatcttccctatttggaaaaaattggtcgtcaagctaagaaagttattctttcaactggtatggctgttatggatgaaattcatcaagcggtgaagattttgcaggaaaatggaacgaccgatatttcgattttgcattgtacaaccgagtatccaaccccttaccctgctttgaatttgaatgtcttgcataccttgaaaaaagaatttccaaacttaacaattggctattcagaccatagtgttggttcagaagtacccatcgctgctgcagcaatgggagctgaattgattgaaaagcactttactctggacaatgaaatggaaggaccagatcataaagcgagtgctactcctgatatcttagcagccttggtaaaaggagtgaggatagtggaacaatctcttggtaaatttgaaaaagagccagaagaagttgaagtacgaaataaaattgtagctagaaaatctattgttgccaaaaaagcaattgctaaaggcgaagtctttacagaagaaaacatcactgtcaaaagaccaggaaatggaatttcgccaatggaatggtacaaagtcttggggcaggtgagtgagcaggattttgaggaagaccaaaatatttgccatagtgcttttgaaaatcaaatgtaagcggagtaaggatgaaaaaaatttgttttgtgacaggctctcgtgccgaatatgggattatgcgtcgcttattgagctatctacaggatgatccagaaatggagctggatcttgtagtgacagccatgcatctagaagaaaaatatgggatgacggtcaaagacatcgaagcggacaagcgtaggattgtcaagcggattccattgcatttgacggatacgtctaagcagacaatcgtcaaatctttagcgaccttgacagagcaactcacggttctttttgaagaagtccagtatgacttggtgttgattctgggggatcgctatgagatgctaccagttgccaatgctgcgttgctttataatattcctatttgccatattcatggtggtgaaaaaaccatgggaaattttgatgagtcgattcgccatgccattaccaagatgagtcaccttcatctgacatcaacggatgaatttagaaatcgtgtcattcaactaggagaaaatcccaaccatgtactgaacatcggagctatgggtgttgaaaatgttttaaaacaagactttttgacaagagaagagttggcgatggaacttggaattgattttgccgaggattactatgttgtactctttcaccctgttaccttggaggataacacagccgaagaacaaacgcaggccttattagatgctctaaaagaagatggtagccagtgtttgataattggatccaattcggatacacatgccgataagataatggaattgatgcatgaatttgtaaaacaagactctgattcttacatctttacttcgcttccaactcgttattaccattccttggtcaagcattcacaaggtttaatagggaattcttcgtcaggtttgattgaagtgccctcattacaggttccgaccttaaatattggaaatcgccaatttggacgtttgtcaggaccgagtgtggtacatgttggaacttctaaggaagcgattgttggtggtttggggcaattacgtgatgtgatagattttaccaatccatttgaacaacctgattctgctttacaaggttatcgagctatcaaggaatttttatctgtacaggcctcaaccatgaaagagttttatgatagataggggagaaagtttgatgaaaaaagtagcctttctaggagcgggtaccttttcagatggtgtccttccttggttggatagaagtcgatatgaactcattggatattttgaagataaaccgatcagtgactatcgtggctatcctgtatttggtcccttgcaagatgtcctaacctatttggatgatggaaaagtagatgctgtcttcgtcactataggtgacaatgtcaagcgcaaggaaatctttgacttgcttgccaaagatcattatgatgctttgttcaacatcattagcgagcaagccaatattttttccccagatagtatcaagggacgaggggttttcataggtttttcaagttttgtaggagccgattcctatgtctatgacaattgtatcatcaatacgggtgccattgtggaacatcataccacggtggaggcccattgtaacattactccaggagtgaccataaatggcttgtgccgtatcggagaaggcacttatattggaagtggttcaacagtgattcaatgtatcgagattgcaccttatacaacattgggggcagggacagttgttttgaaatcgttgacggagtcagggacctatgttggtgtacctgctagaaagattaaataggtgaattgatggaaccaatttgtctgattcctgctcggtcaggatcaaaaggtttaccaaataaaaacatgttatttttagatggtgtaccgatgattttccataccattcgagctgcgattgagtctggatgttttaagaaagaaaatatatatgtcagtactgattcagaggtttacaaggaaatttgtgaaacaactggggttcaagtcctcatgcgtccagctgacttggcgacagattttacaacctcttttcaactgaacgaacattttttacaagatttttctgatgaccaagtatttgttctcctgcaagttacgtccccattaagatcgggaaaacatgtcaaggaggcgatggagttatatgggaaaggtcaagctgaccacgttgttagctttaccaaagtcgataagtctccaacattgttttcaactttagacgaaaacggattcgctaaggatattgcaggattaggtggcagttatcgtcgtcaagatgagaaaacactctactatcctaatggagcgatttatatttcttctaagcaggcttatttagcggataaaacttatttttctgaaaaaacagcggcctatgtgatgacgaaggaagattcgattgatgtagatgatcactttgattttactggtgttattggtcgaatttactttgattaccagcgtcgtgagcaacaaaacaaaccattttataaaagagagttaaagcgtttatgtgagcaacgagtccatgatagtcttgtgattggcgatagtcgtctgttagccttgttactggatggtttcgataatatcagcatcggtgggatgacagcttcgacagcacttgaaaaccaaggtctctttttggctactccgataaagaaagttttgctttctcttggtgtgaatgatttgattactgactatcccttgcatatgattgaggatactattcgccagctgatggaaagtcttgtttccaaagcagagcaggtttttgtgacgacgattgcctacacgctgtttcgtgatagcgtttcaaatgaagaaattgtgcagctgaatgacgttattgttcagtcagcaagtgaactgggtatttcagtgattgatctaaatgaagttgttgaaaaagaggcgatgcttgactatcagtataccaatgatggattgcatttcaatcagattggacaagagcgtgtgaatcagctgattttgacaagtttgacaagataatttggtgatagaagctatttcagtggctagactatgttggtatgtgttttagagccaaggaataacatctgtagaggatgctagccttgagaattgacaaccatttagttgtttaattatataaggggacctctaaaaactccctaaatttcccaaaaatgagataatagaataaaaagtaatgaggagagctgtcatgcatttattcacagacgatgaaaaaatcttgtcaaaactatcagagaaaggcaatcccttagaacgtttggatgccgttatggattggaatatctttcttccattgttgtcagagttattcagtcgtaaagataaagtcatcagtcgtggcggtcgtcctcacctagactatctcatgatgttcaaagcgctcttgcttcaacgtcttcataacctatctgacgatgccatggaatatcaactgctggatcgtatatcttttcgtcgttttgttggttgtcatgaagacactgttcccgatgcgaaaactatctggctctatcgtgagaaattaaccaagtcaggtcgtgaaaaggagttgttcgatttgttctatgcccatctcacagatgaaggggtgattgcccattcaggtcagattgtggatgctacctttgtcgaatgccctaaacaacgcaattcacgtgaggacaatcagaaaatcaaaacttatcgaaaattatgaggtcacaacagctagtgtacacgactccaatgtcctagctcctctttgtgatgccaatgaagcggtttttgatgacagtgcttatgttggaaaatcagtaccagaaggttgtcgccaccacacgattcgtcgtgcttttagaaataaaccgttgactgagactgataaggtcattaatcgacatattaccaaagtccgttgtcgcgttgagcatggttttggcttcattgaaactaacatgaaaggtaacatctgtcgagcaattgggaaggcacgagctgaaaccaatgtgaccttaaccaacctgctctacaatatctgtcgttttgagcaaatcaaacgactgggattaccatcgtgggcttagtgcgcccaaaaataggaaaataagcaaaaagaggctgggcaaaaactagtttctcacaataaaaaaacggctctttgtcaactgtagtgggtagacgaaaagctaacacctagagaggacgaaattcgttctctcatttttgatgtttaaagcgtaaccgcctaataacaaggtatctatccaatcacacattcctccattatatagttaaatgaaacaaaaacagtacatttatgatataatgtatttatggcatattcattagattttcgtaaaaaagttctcgcatactgtgagaaaaccggcagtattactgaagcatcagctattttccaagtttcacgtaacactatctatcaatggctaaaattaaaagagaaaaccggcgagcttcatcaccaagttaaaggaaccaagccaagaaaagtggatagagataaattaaagaattatcttgaaactcatccagatgcttatttgactgaaatagcttctgaatttgactgtcatccaacagctattcattaccccctcaaagctatgggatatactcgaaaaaaaagagctgtacctactatgaacaagaccctgaaaaagtagaactgttccttaaagaattgaataacttaagccacttgactcctgtttatattgacgagacagggtttgagacatattttcatcgaaaatatggtcgctctttgaaaggtcagttgataaaaggtaaggtctctggaagaagataccagcggatatctttagtagcaggtctcataaatggtgcgcttatagccccgatgacatacaaagatactatgacgagtggctttttcgaagcttggttcaaaacattcttactacccactttaggtaaaccatctgttatcattatggacaatgcaaagtttcataggatgagtaagctaaaagatttatgcgaggagcagggacatagacttttaccacttcctccttactcaccggaatataatcccattgagaaaatatgggctcacatcaaaaaacacctcagaagagtattgccaaattgcgatacttttcttgaggcactttcgtcctgctcttgtttcagttgactatactgttataaaaaacaaactggaggattcattatgtcacagcccgtcgtcccattgactattccccaatctcgccgctttgaaaagaaaagcagaaacgatattctgatgaaaattcgtctcggaaaaacggaagtcacattcttccaatctatcaaccctgaagtaatggaaacaatcttggataaggtactgcattatgaccatccgactcagtgatttaggtcaagtcttcttggtctgtgggaaaacggatatgcgtcaggggattgactctctcgcctatcttgtcaaaagtcaatttaatctggatcccttttcaggtcaggtctatctcttctgcggaggtcgaaaagaccgattcaaagctctttactgggatgaacagggattttggttattgtataaacgttttgaaaatgggaaattggcctggtcaaacaatgaagaagaagtcaaggctctaacttccgaacaagtagattagctcatgaaaggattttctatcattccaaaaataaatgtttcaaaaagtcgtgatttctattgaaatcatggcttttctttgtgtataatgagataaaaagaaggaggagcgagcgtatggatgagttgttggcaattattaaacaacagacctcaacgattgaacaacttaccaatgagctaaccctccttcgagaacaggttgactatctgagacagaaactctacggaaaatcatcagagaaagttgtgtatcaacccggtcagctgagcttgtttggggaggaaagcctccctgaagaagaagctgacttacccagttgaaacagagatcatcacttataaacgcaagaaaactaagggagttcgtcaggctatttttagtcagttcactccagagatagtgcatcacgaattgcagggcgaagactgcacttgtccagactgtcatggtcagttgaaagagattggctcagctgttcaacgacaagagttggtcttcattcctgcacaattaaagcggattgaccatgttcaacacgcatacaagtatcaggcatgtagccagaagaatctgagcgataagattatcaaggctcccgttcctaaggcacctttggcacacagcttgggttcagcctctatcatcgctcacaccattcatcagaagttcaatttgaaggtgccaaattaccgtcaggaagaggattggcataagcttggcctgcccatcagtcggaaggaaatagccaactggcatatcaagtctagtcagtattatttcgagccgatttacaacctgttgcacgagaaattgttggagcagcctattctccatgcggatgagaccgcctacaaggtcttagaaaatgatggtcagttgaccttcttgtctgggaaacatgaggaaaatggaattaccctctatcatcatgacaaacgacggagtggcttggttgtggaggaggttcttggggactatgcgggctacgtacattgtgacatgtggagtgcttatcgtcaattagacaaggctcagctggttggttgttgggctcccgtcaaacgaaagttctttgaggcgactcctaagaagacagacaagacttctttaggagcccaagggcttagcctattgcgaccgcctgtttgccttggagagttgactgggctgacttgtctagcgaggagcgactgcataaacgctggctcccttgatggacgagttctttgactggtgtcgtgagcaatctgttttgccaggctccaaattgggtactgctttggagtatagcctcaaatacgaaaccaccttccgaaccgttctctcggatggtgacttggtcctgtctaacaacatggctgaaagggctatgaagaccttggtgatgggcagaaaaaattggttgttctcccaaagttttgagggagccaagtcgacagctatcattttgagtcttttggaaacggccaagaggcacgaacttgatacagagaaatatatgacctatcttctagacaatctacctaacgaggaaacactcgctaaaaaagaagttctagaggcttatttgccatgggagaagaaaattaagagagcatgtaaatagaaaaaggttccagagtcaacaggactttggagccttttcaatataccttattattgggcggttacaaagtagcctaggaaacgaagccgaagatagaactggagttggagttcatcaaggcaagttgacaacggataattttgattttcgaagagtatcaataaaaatcaaagatagcaagtctaagctacttatgaaagttctataatgaagtcaaacgtgggacaactttacaacaagtgcgaaaagggctgtacaaaaaagtctattctgctgactatgcacaaacggtataccgaactaatcgaaaacgatcggtaaaaaagataatcctaacgaaagaattgaaagagaaaattttacactatactaagcaaaaattttctcctgaaatgatggttaagaagaagaaaatgaaagtgggtatttcaaccatttactattggtttcatcatggccatttaggattgacgaaagcagatatgctttaccctagaaaagggaaaagggtcaagaagcaagctagtcctaactttaaaccagcaggaaaatctatcgaagaacgtcctgacgttattaatcttcgcttggaaaacggtcattatgaaattgatacagttctactaaccagagggaaaaatcattgcctcttagtcttaaccgaccgacgaagcaggcaccaaatcatacgattaattccaaacaaaaccgccgaatcggtcaatcaggcactggagggaatcttgagggaacatcgtatcctgtctataactgtagataatggtacagaatttagtcgtctggctgaagtgtttcctgaggagtatatctactatgcgcatccctattcttcatgggagaggggaacgaatgaaaatcacaatcgattgattcggagatggttacctaaaggaaccaagaaaacgactccaaaagaagtcgcttttatcgaacattggatcaacaactaccctaaaaaatgcttggactacaagtcgccgagtgaatttcttatgggtggctaatttcaacttgaaatttggggtctaagctacttataacatttgaaaccttaatttataagtttgagttgaggattgtggatttcaagcagctgttttcttctaaaaaaataacaaaatcgaaacggtccatatccactttgagtggtagttggctatttttgattttaaatgagtatcacaccccatcgtcccattgactgttccccaatctcgccgctttgagaagaaaggcagaaatgatattctgatgaaaattcgtctcggaaaagtggaagtcacattctttcactctatcaaccaagaaacattagaaacaatcttagataaggtactattttatgaccatccgactcagtgatttaggtcaagtctacttggtttgcgggaagtagtggtgtgatttggttaagaggattatgctcacttagaatttctacctgcttgctttgagagacatgagtgtagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagacttaagcgcacactttgttctttaagatgatcatcgttttcacactggtaaatagataactagaatgactacaatgatgcgctatatagtcttcaagtaacgaaagtgttttatcgtttccaatatagagtagtcgcactttctttccttttccgagtatttgaatggttctattttccaaattgatattatcaagttttaaattacataattcagagatgcgtagaccagttgataaaagtagcgagataaggagtagatttcgcatagctttccgattagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttacgttttaatgtgctagtcttttttatatgttggttgagaaaagtaagataggacctaatatcattggtcctaaagctataatactaatgtaaattggatttgtatgcttggatagtatgagaactaagtcgtctttgaatagcacaaaagtcaagatatctctggatagtgtcgtaattcataatataatctccttaatatgtcgtaataaagctattatatacgataatttatcaatttactaatgataataaattgttatcggtaggagatcttatgaagcaattgctacagtattatttacaaaattttgataaagagtgctctaagaccaatttatttttagttgctaatttacaaaaacaaactaaaaaaatgtcttattatacaattgaacatgcatctggtcgtgaatttttttcgctatcagaatttgaggaaatagcttcagcactgttaaaaactggtttatgtttgaacattttttatactgaaatagatttcgtggagtatatattaaaatactattagcgcttatcaaaagaaactttgttagtttataatttggctagagacggtcgaaaagaaggaaaaaaatcgctgattccctctttttgcgattactttagcattaattatacaggttcaaatgcactaacagtttcattatgtcgtaataaatttatttggggagctattgcagattactttaatattccaacacccaaaactgtttgtataaaagatggcgaggtattaggtgagccttttgaagctcaaaaatatattagaaaagaaatttcggaatctgcaagtattaatctttccaatgattcaataatgaataattttgagtggaaaaatatagaaaaaaagattttctgttgcaagagtgtatttcaggaattgaagttgaagtcccttttttaatattaaagggaaatatcttgtattagatccagtcaaaattgtctcttcttcagaaattataacaagcaaactatctgataataatagttattcatttgaatggttggaagatcaacaaatatgtacaaaattaaaagagtcaacaaaaaaactcgccaagtacttaggtataaccacttacggacgagttgattttagaataaagtcagatgggagttattttgtttttgatattgcaacaatgccttacacaactgaccatcgttcatttaattttaactttgagcaatatggacttacaatgactgatcttcataaactagtaatattaagtagtttataatgcactagtatactgtatatcagttagcataaggcctcttcgaaagtaattccattctcttgaagcaaacttggattgtgatagaaattcagaaaattcctttcctgtttttatatttgattcgaaaatctttttatagcgacgatgtttttcaattaataattttttatttgaattgaaaataataggtgagaaatcttttaattgattgtatttattttttgcttgtcgatgcttactctctagtaacaacaagcaaaattcaaaccatccaaaataataacgataaaaatcatctattgaggtatcttcaaggtcggctaagtcctcaacatccatcaattcttcaagtatcgttttatagcttctgtacccttttgttttagaataatatagagaaattgcacataaatttgtatacattaagtgtttactcacatcatttaactcatattcagtaagaatgctttcaaaccgagatttccaataatcaaaatctccttccatacctgaaagaaagtccagtacaacaaaattatttttagatttccagtatagtgggagattgtgtttatctgatagtgtttctatttcttgtttcacctgatttgctcgctcatagttggaagaaacaagtaataatcctagaagactaccaagtgtataatactgttcaatttcatcatcgacatcgttaaaaaattttaaagctttattggcatcattgattgatctatcattatccttgtataaaaaactttttcttaaatatatattttcaagatattgtgcattttgctcaatatcttttgttgtataaaattttttgacaatattttcatttaaaacttggaatttatcaatttcattaagtttatctatattaagtttatctattaaatgaggtaatagcatgtaaatacatgaaagatagtgaataggctcaacaataacatctttggcgctttcagctaatatattttcgtaaagtgtatcacaaagtgaatgaaaagaaaaatcttgtgatgtatttccttgaaagttaatatcattctttaataatatcgaagataataatgaattttcgggtaaaatttcattataaagagagttagtaccatttgtatatttgtatttgatacatttaaaaaatattgatttagtctcttcagtgagaaattcaagtttatataaactctttttttcgctttctagtatctcgttttgatttaataaatattcataccagagtaagtatagtgataataaatattcttgactctctttaagtcttgataagatttctatctttaatctgtaattaaatggctcctttccgcatagataatgatagtaccgtctatagatttctttttgtcctttttcaaccgttaaaagaagcttatctttcataatcaatatcagactataaaaatttgttctattttttacaggaatcaagactagtaatttttttaagatatcaatagctttttcaatttgaaaagtttttaaattaaagtattcttcggcatcatacgggttgaaatattcaggaaggactgatagctgataaatgaaatcaatttcaattttattctttctaaagtctatttcaatcgtatttaacaaatcatctaataacttttcaatcttagaattattctgtgatagtaaaataaaattataaattttttccaagtttccctttgttagaggatacagtgtatcctctaagttatcagagatgtttgaagtttgtataatattacctaaagtatcttttaaatcgtttaattcaaaatgatgaacatcaaagttttttgaaaatctaatatcattattttttaactccgagcctccaattacaataataatcgatttattatattgcttttcataatgggagatattattgagaaggcgtataaaaaataattttagttcactccctagccactcccaatgttggattagaaatattaatctgtaattgttgctattatttagtattttcttctctatctcagttgaatcatattttaatgacagaccagctgttccaaatccttgtatcgagttattaacagatactgaaataggcttgaaaaatttttctgcaaatgaaagtttatactcgtctgtaatattgttatctccgaaatcactatacaatactgtaccattcccgtcaatttcgctttccaatagttcctgtgatattgtatcaaatgctaaggattttgataaagaatcttcgaacgggatatatagtgaaagtgacttttgatctgtatgtgcttgaataattgaataagtaatttctgttaaaaattgattccaatgagacataattaaactttcctaccgataacaatttattatcattagcataccataatctacatttgttttatagattttattaaaatttttatagtaaatatttttagttttttgtttcaaaaatgtaatggagattgatttttcacaagtaattgtcataaaaatcagaaaatattttataaatatgataaaatgaaagtgatactagtttgaggtaaggatatgaaattaagaagaagcgtagaaaaactaaagggaacgattcgtgtcccaggtgataaatcaatcagtcatcgttctattatttttggttcccttgcaaaaggtgttacccgtttccacaatattttacgtggggaagatgtcttgtcaaccatgcaggtctttcgtgatttgggtgtaaaaattgaagacaatggtgatattgttgaagtacacggtgttggctttgatggtcttcaagcccccaaaaatgatttggatatgggaaattctggaacctcgattcgtttgatttcaggcgttttagcaggtcaagactttgaggcgactatgtttggtgatgattccttatccaaacgtcctatggaccgagtaactattccactcagtcaaatgggagtagagatttctggacaaactgaacgtgacctacctccgttgaccatcaaagggaataagaatttaaaaccaattcgctaccaactccctgtagcctctgctcaagtaaaatcagctctgatttttgctgccttgcaggctgagggagagtcggtcatcgtagaaaaagagttgactcgaaaccatacagaagatatgattgtccagtttggtggacagttagaagtcaatggcaaggaaatccgcatccaaggtggtcaggagtttattgcccaagagattacagttccaggagatatttcaagtgctgctttttggttggttgctggcttaatcataccaggttcaaaaattgtccttgaaaatgtgggaatcaatgaaactcggactggtattttagatgtcattaaagctatgggtggtaaaatgactctttctaacatagatgaacttgcaaaatctgctaccattacagttgaaacgtcggaattgaaggctacggagattgcaggcgaattgattcctcggttgattgatgagttgccgattattaccttactagcgactcaagcacatggaacaacgattattcgtgatgctgaggagttgaaagttaaagaaacggatcgtattcaggttgttgcagatgctctaaatagtatgggagcaactattgaaccaacagaagatggtatgattattcacggaccaactgctttacatggtgctgaaatcaatacatttggtgaccaccgtatcggtatgatgactgccattgccgccttgttggccaaagatggagaagttgtattggaaagagcagaagctatcaatactagctatcctgccttctttgaacacttaaatagtttgatggattaggagaacgtatgccaatcgttttacttggatttatgggagttggaaaaacaacaacagcacatttgttaaatctccccgtttacgatatggaccatatcattgaagaacggattggtatgcctattgctgactatttcagtcttgaaggagaggcttcgtttagacaactggagacagaggtactgaaaggattgctggacttacctagtaattgtatcgtatcaactggtggtggtgtgattaaatctgaagtaaacagggaattgctgttggcaaatagggaggacaatgtacttcttactgcctcctttgaagtttcctatcagagaattcgtaaggatagacagtcgcaaagacctctctttttacagtgtagtaaggaagagtttgaagccctctatcgtgaacgaatggcactttatcaaggtttagccgatactgtaatcgatacagataaactgattccagaacaagtagcaaggaaaattttatgcaagtagcctatctaggacctcgtggttcttttacacatcaagtggcccagcaggtctttccgactgcggatttgcaggcttttgagacgattacagaggttatcaaggcctacgaaacgggggaagttacctattccgttattccagtagaaaactcgattgaaggtagtgttcatgaaacgattgactacctctttcatcaggcggagattcatgcggttgcagagattgttcaaccgattgcccaacaactgttagccacgagtgccgataaggctgtagaggttatctattctcatccgcaggcaattgctcaggggaagaaatatattcaggaacattttcctcaggctcgtattgaaataacagttagtacagcctatgctgctcgctttgtggcagaacaccctgaacaaccatttgcggcaattgctccgcaagcggcagcagttgaatatggactggaagtaattgcgcaagacatccaggaaatcagcgagaattttacacgcttttggattttgggggataaggctccgtctattgccctggaacaagtagctaaaaaagtcagtcttgcactgacattgccagataacctgccaggagccttgtataaggccatgtctgttttctcatggagaggaatcagcttaacaaaaatagaaagccgacccctgaaaacggctttgggtgagtattttttcatactggatcttgacaatcagtctgaggaattattaacctattctcaaaaagaattgactagtttagatataacctataaagtactagggaattacctggtctatatgaccagctaggatgaagacagatgaataaaaacaataatatcctaacccatcatgaacaattgaggttagattatttgcaaaaaaatatccactacttaaatgacaaagaaagtcgcgagttggattatctattatataaaaaagagctgagagaacggcatggaagtccaaggcaatctctacgtagcttcacaccaacggcttatgaagatgactacttcgaggaagattattttgaagaggatgatgagcaagaggaactgttgcctcgctatcctgaacgtaaatccagaaaaacaagacaagccaaacctcaacggtttcagtctcctcgtatcggtcccaaagcgaaagtacctaaacctaaaaaagctcgtaaaaagggtggtttcaagcgctttattggtttcgtattgcttgctatagcgctagtgattgtagcgatgggctatagttttttcaaaggtatgaatagcgtgagtgagaagccagtagctgaggtcttcaacggcgtagatacatcgaatgggacaaatattttaattttgggaacagacggtcgtgttggcgaaagctcaggtgaaactcgaacggataccatcatggttctaaatgtgaataacacggataacaaagtcaaacttgttagctttatgcgggataccttggtggatattgagggatatgaatataaactcaatactgcctatactttgggagaacaggataatcagcaaggggctgaagaagttcggaaggcgttgaagaatagttttgacattgatatcaagtactatgcgatggtggattttgcaacctttgcgacaacgattgatacacttttccctgagggcgtaacgattgatgcacagttttcaactattaatggtgaagtcgttagctcagtagaagtgccgaatgatttacagctggaagaaaatgctcctgcttatcaaacgattcaggtcggtgtacagcagatggatggtaagaccttgcttaactacgcgcgctatcgttcggatgatgaaggtgattttggtcgtacgagacgtcaacaggaagtgctatctgctgttatgacacaggctaaaaatccaatgaaactattctctggctccgaagctataggtaaggttgtggccatgactccgacaacagtaccgcaaagctttatgtggctacagggaccaggccttctattggatgcggcaaatggtatcgaacgtgttacaatcccagaaaatggagactggattgacgactatgatatgtatggtggtatggctcttcgtgttgattttgaaaaataccagcagcgcttggctgagttaggcctgcgttaagaaatatggtatactagaagtgacttcggtcactttttagtggtccaaaaatagaaagtagaattatgttaaagaaaaacgatattgtcgaagtagaagttgtagatttgacacatgaggggcagggtgtggcaaaaattgatggttttgtcttctttgtagacaatgctcttccaggcgagaaaatttccatgcgcatcttaaaacttaagaaaaatattggttttggtaaggtggagcaatggcagagcttctcacaagaccgtaatcaggacttggattttacctatctaagaacaggtattgctgacttggggcatctcacttatccagcccaactagcttttaagaaaaaacaagttgagaatagtctacgtaagattgcaggcatttcagaaatagcagtagcagatacgttgggaatggacagtcctcttgcttatcgtaataaggcagctgttccagttcgtcgtgtgaatgggcagttagaaacaggattcttccgaaaaaattcacatgatttagttccgattgaggatttttacattcaacacaaggaaattgatgccttggttctagcgacacgtgacctcttgagaaaattagacttgaagccttacgatgagaaagaacagacaggacttgtgagaaatattgttgttcgtcgtggtcattattcaggtcagttgatgctagttttagttacgactcgtccgaagattttccgtgttgaaacccttattgagcgtttgacaagccaatttccaaatcttgtttctatcgttcagaatattaatgaccagaataccaatgctatattcggtcaagaattccgtcttttgcatggcagtgaaactattgcagataccatgttgggcaatgaatttgaaatttctgcaccgtctttctatcaagtcaacacagaaatggctgaaaaactctatcagaccgccattgattttgcagaattgtcggcagatgatgtcgtgattgatgcctattcaggtattgggacaattggtctctcctttgcaaaacaagttaagcatgtttacggtgtagaagtcgttgaaaaggctgtccttgatagtcagaagaatgctgctcgaaatgggattgataatgttacttatgtctgtgatagcgctgaatccgctatgcaaaaatgggtggcagatggagtcaaaccaactgtgatttttgtcgacccaccacgaaaaggtttgacagaaagttttatcaaagcaagtacttctgtaaaaccagagaaaatcgtctatatctcttgtaatgtggcaaccatggcgcgtgatattaaactttatgaggaattggggtacaaattgacgaaggtacagccggctgatttatttccaaatacgcatcacatagaagttgtgggattattagaaaaacgcaattagattgtccagtatgctctcctgttttttggcaagcagcttcaaaggaccccaggacctttgaactctcaaatacgcatcatgttgacagttgccacacctacaccaaaatcaaatgccaacaagcgttgagtcgggtaatagcgtaagtagcgcaaggtcatgataagctgctcttccatacttagacggcgtgggcgtcctccttttcggtgttgctcttgataagcgtcagtgagacaatcaagcatcagatgaaacgtcgcttttttacacctatcaacaatttgaaattctctgagtttaattttaagactttttcgtatgttgtttccatacctttagtataccgcctttgagttaccgaacaagtctattgctaaacttgatgaaggttgtattgtctgttataatattggatattgcaagctttaagtgaaaggttttagggaagagattatcacaactcattctttattagttatgagacgatggtattaatgatagtctagtaaaagatttggagaaatgacttccttagaaagttaaatgtaaaaacaatatgaaaaaatacgattatctagttgtcggagcgggtctgttcggagcggtctttgctcatgaggcagctaaaaagggtaaaaaaataaaggttatcgaaaaacgagaccacattgcgggtaacatctatacaaaagaagtagaaggtattcaagtccatgaatatggcgcacatattttccatacttctgaaaaagaaatttgggattatgtgaatcagtttgcggagttcaacagctatacaaacacaccagtcgccaactacaaaggtgagatttacaatcttcccttcaacatgaatactttcaataaactgtggggcgtggtgacacctgctgaagcaggagcgaagattgcagagcaacgagctgtgttgggtggtaaaacgcctgaaaacttggaagagcaagccatctcacttgttggtacagacatctatgaaaaattgatcaagtcctacacagaaaaacaatgggaaaaaccatgtacggagttaccagccttcatcatccgtcgtttgcccgtgcgtttgacttatgataataactactttaacgatacttatcaaggtattccaatcggcggttacacgcagattgtagaaaaaatgttggaacatgaaaatatcgatgtggagacaaatgttgatttctttgccaataaggaagactatttagctacctatccaaagattgtctttacaggaatgattgacgagttctttgattaccaacttggtgaattggagtaccgtagccttcgatttgagacagaagtgttggatatggaaaactatcaagggaatgcggttgtcaactatacagatagcgagacaccatatactcgaatcatcgaacacaaacacttcgaatttggtacacaaccgaaaaccattattacacgtgagtattcgaagacctggaaacgaggcgatgagccatactatccagtcaacaataatcgcaataaccatctatacacagcatataagaaattgtcagaacaacaagagaatgtcatattcggtgggcgtcttggtcattatcgttactacgatatgcaccaagtcatcggagctgccttacagtgtgtgagaaatgaagttggggaatgattttgagaagtcatcaaagtagtaattattcttggcagaagtcggaatgctcttaaaatgttaatcaaaaaaaccagaaattctggttttttttgattattattgaattgctgccaacaggtcagctacttgttgttcgagttttgttagagtttcgtcagataactccaatacacctgttccccatgcttctggattgatggttgaacctgtaaattcaccagcaatctgagtgcgaataaatggaagaaggtgttggaagtctttgaataggtggtcgtgaccactgtttgcgactgcagagacagttgtgattttatcttgtaggatagatggtccttttggattggataaatcgagcgaacgactgagccaatcgagagcattttttacgatgcctgggattgcatagttatatactggtgagaaaatccagatagcatccgcagcgtctacttgtgcacgtagctctgcaatttcaggaaggataggtgtctcgatgtcttggttgaataggggaatttttgcaagatcaatgtaagatacttgagccttatcagtcaagaatgcttcagctttttttgccatttgatggttaaaagaaccgtcacgtagtgaaccaactaaaaacaatacgtttgccatgatggcctccttttcataaaaacataaatttagtatatcgtatttgtcttttgttgacaatcctaggtctgctgattcttgaattttttaagtatctcggctaattggtcttgttcttctgaactaaggacagaaaaaatctctccaacgtgatcataatgctctggaaggattttttcaatggtttcgcgtccaagtggagtgagagcaatcaaggaagcacgacggtcatttgtatcgatagtcttgtagatataaccatctcgaatcatgttctttataacgacagtcatgttgccagaagtgcttaataatttatcaattaagtcttgaatccgcagatttcctttgttgtagagtgcctccatcactccaaactgacaaactgtcagtccgtattttttgattgtttctaattctgattttgcgatagtattagctgctctgcgaaagacgactagactgtgaagtgcatgcttgttctcgtttaaagattgttcaacagttctcatgagaatattttagcaataaatcgttcggttatcaagcaaaaaaagttaaatcctatattcataggtaaagtacttttatggaaaagatagtttttagttaatcaagttcgttttttgaggtaatactaactgtactggaaaaaacgagcaatgagcatttgagaaatagtcttagatggaagtgcaaaactgtgaatgtaggtttttatatccttttctttgtgtgaaggaaaaggaaattttatttatagttaaatgaaacaaaaacagtacatttatgatataatgtatttatggcatattcattagattttcgtaaaaaagttctcgcatactgtgagaaaaccggcagtattactgaagcatcagctattttccaagtttcacgtaacactatctatcaatggctaaaattaaaagagaaaaccggcgagcttcatcaccaagttaaaggaaccaagccaagaaaagtggatagagataaattaaagaattatcttgaaactcatccagatgcttatttgactgaaatagcttctgaatttgactgtcatccaacagctattcattaccccctcaaagctatgggatatactcgaaaaaaaagagctgtacctactatgaacaagaccctgaaaaagtagaactgttccttaaagaattgaataacttaagccacttgactcctgtttatattgacgagacagggtttgagacatattttcatcgaaaatatggtcgctctttgaaaggtcagttgataaaaggtaaggtctctggaagaagataccagcggatatctttagtagcaggtctcataaatggtgcgcttatagccccgatgacatacaaagatactatgacgagtggctttttcgaagcttggttcaaaacattcttactacccactttaggtaaaccatctgttatcattatggacaatgcaaagtttcataggatgagtaagctaaaagatttatgcgaggagcagggacatagacttttaccacttcctccttactcaccggaatataatcccattgagaaaatatgggctcacatcaaaaaacacctcagaagagtattgccaaattgcgatacttttcttgaggcactttcgtcctgctcttgtttcagttgactatacaatcacagaaagaatggaaatatgctttaatttgtagtataatgggactgttatggaaaaaaagatttttcaactgttggagtggatggcttccaagactggtcagttagtgatgggctcttttatccttctcagtgttgtgactttttcaatttttactatttgggatattgctgctgcccctttcaacaatgcgcgtagtcatgcagttggagtagctacagaatatgctgatttgcaaactgtcaatgatttttctatctacaatggtactgaaacctatttttgtgtatttggtgtcaccagtcagggagaagaggttgcagttttgattccagaggcttctagcacagtatatgtctattctttagctcagggaatttcgcaagaagaagcgcaagctattgccaagaaaaacggtgcaagccaagtagagcgaactattctaggtttaagggatggcaaacctatttgggaagtcaagtcaggtactgcctactatttagttgaatttgaaacagggaactttatcaaacgggagggcttatgagcaagctatcaaaacgtgtcttagaaatggaagaaagtgtcacgctggcagcgggtgcacgggcaaaggccttgaaggcagaaggacgtgatattttagagctgaccttgggtgagccagacttcgttacaccgaaaaatattcaagaagctgctattaagtctatcgaagatggtaaggcgagtttttatacggtagcttcaggtctgccagaattgaaggacgcggtcaatacctactttgagaacttttatggctactctatcgaacgcaatcaagtcgttcttgccactggtgccaagtttatcctttatgctttctttgcggcggtcatcaatcctggtgatgaggttctgattcccacaccttactgggtttcttatgcagatcaaatcaagatgaatgatggggtgcctgtctttgtcactgcaagtgaagagcacaatttcaaggtaacagttgaccagctggaagcagctcggacagataagaccaaagtattcctactcaatactccttctaatccgactggcatgatttacagtcgtgaggaattggaagctattggcaactgggctgtagagcacgacattctcatcttggcagacgatatttacggtcgtttggtatataatggaaataccttcacaccgatttcaagcatttcagaaagcattcgtcagcagactattgttgtcaatggggtggccaaggcctatgccatgacaggttggcgggttggatttgccgttggtaatcctgagatcattgcggctatgagtaagattgtcggacaaacgacgtcaaacttaacaaccgctgctcagtatgcggccattgaagcctttacaggtccgcaagatacggtcgaaaccatgcgtcaggcatttgaagagcgactcaataccatttatcccttgctggcagaagtgcctggttttgaagtgattaagccagaaggtgccttctatctcttcccaaatgtcaaaaaggctatggaaatgaagggctacacagatgtaactgaatttaccacagccattttggaagaagtgggagttgcaatggtgacaggtgctggttttggagctcctgagaatatccgcctcagctatgcgacagatatggacacgctcaaagaagcagtggctcgactacacacatttatgaaaaaataaaaagaggaaaaataatgtctagaaaattgattaccatcaaccaagtaaaagattatgtcggtcaagaagtgaccattggtgcctgggttgctaacaaatcaggcaagggcaagttagccttcctgcaattgcgtgacggaacagccttcttccaagcagttgccttcaaaccaaacttcatcgaaaaattcggtgaagaagctggtactgagaagtttgatgtagcaaaacgccttagccaagaaacgtctgtctatgtgacagggattgtcaaggaagatgagcgttctaagtttggttatgagttggatgtgacagaccttgaagtgattggtgagtcacaagattacccaatcacaccaaaagaacacggtacggacttccttatggacaaccgtcacctctggttgcgttctcgtaaacaggtcgctatccagcaaatccgtaacgccatcatctatgcgacttatgaattctttgaaaagaatggctttatcaagtttgatagcccaatcttgtctggaaatgcggcagaagattcgacagaattgtttgaaacagactactttggtcagcttgcctacctcagccaatctggtcagctttacctggaagctggtgccatggcccttggtcgtgttttcgacttcggtcctgttttccgtgcggaaaaatcaaaaactcgccgtcacttgacggagttctggatgatggatgccgagtattcattcctcagccatgaagagtcacttgacttgcaagaagcttatgtcaaagccttgattcaaggtgttatcgaccgtgctccacaagccttggaaactcttgagcgtgatgtggatgctctcaaacgctacattgcagagccattcaaacgtgtggcttatgatgatgctattacccttcttcaagagcatgaagctgataaagatacagactacgaacacatcgagcatggtgatgactttggatcaccacatgaaacttggatttcaaactactttggtgtaccgactttcgttgttaactatccagcaagcttcaaggccttctacatgaagccagttccaggtaatccagagcgcgtgctttgtgcggacctcttggcaccagaaggctatggtgaaatcattggtggttctatgcgtgaggataactacgatgccttggtagccaagatggacgagctcggtatggacaagtcagagtacgaattttaccttgaccttcgtaaatacggttcagtgccacacggtggtttcggtatcggtattgagcgtatggtaaccttcgttgctggtacaaaacacatccgtgaagccattccattcccacgtatgttgcaccgcttgcatccgtaatacagtcgttcagtttttcctttattacgtcgacgtatgaggaaactccgtttccttatttccaagttcaaataatctcatcattatttgaactcgttttgccgtaccttagtacagtctgcagctcgttgcctagtactaaaagtaaactgaaagactgcgaaataaatattcactgacagactacaaacgtggtctgtttttctggtgtcaattgacattttgaacgaattgttttacaatgtattacaagaagaaagtaggtggaatgatgggaattgtatccttgcgattaaacgatgcagaagaagaaattttcagaagctatgctattcatacaggaaaaagcctgtctgagctattcaaaactgcacttgctgaacagatagaagaccagttggactatgaaattggtatcaaggctttgaagaaattccaagaaaatcctgttacacactcgattgatgatgttcttgcggagttagaagatggcttataagcttgttctcagcgatgatgctttgaagcagttgaaaaaaatggacaggcatgtggggatgatgcttgctaaggatttgaaaaaacgtttggacggtttggagaatccaagacaatttgggaaggccttggtaggagactataaggggctgtggcggtatagagtggggaattaccgtgtaatttgtgatattattgataacaaaatggtcatcctggcccttgaaatcgggcaccggaaagaaatctataaaaaatgaagttctaggtaactaggctcggtatcggtgtacttctcagagttcgtgtcaacatctcagcgcagtggttgattggctttaacagtccagtggagtgaagcagttctgggaactgtttcagcccgagtcttgaagcagaaaagctaggtaaaaaggttggagataaggtttgcgaagcaaatctcagcaattcgtgttttccactccaaatctgacctatacgactgatgcgaactttgttcgccttatctctaacctccaaaggttccctgaaactttggagctatgcgggggtggagagatgaactcctttttgacttatcgagttcttccccactccctgttttctttctttttcactgagttttatttataattattctaaataaaatcgtggagaggaaaatgaagcaagaaagtttaggaaaagaaattattcgtttggccttgcctgctacggtggaaaatatctttcagaccttagttggttttgtggataccctcttgattgcacagctggggctggtagcggtgacagcagttggtcttgccaatacgattttgaatgtctatttggcggtctatatggctttgggagttggggcaacagctttgattgctcggtctattggcgcaggagatagggaatctcttacctttcatgtccgtcaagccttagtgctttcagtaggtgtaggtctgctattggggttactatcccttgttttcgggcggcagatgttggtcttaatgggagcagatgcggagagtttggctggcgtccaggtctttttctactgggttggtggtttgactatttttcaggccttgatgactattttgggaacaatcctgcgggcatctggggatacagtatttcctatgaaaatgagcttactgaccaatggttttaatgtggtcttggactatttcttgatttttggtattggctcttggtcaggtttgggtattgtagggaccgccttgggaactgtcttagctcgcttgcttggtactgtcttgctttaccgaaaggtacagcagactgacttggcagttgatctcaaacaattgttccacttgggaagtcctaaggaaatggtggttttgaccctacctgcagcaaccgaacgcttggttatgcggttgggacaggttgtctatttcagtttgattgtggggctgggaacgattgtctatgcttctcatatgattgcaggtaatatcgagagttttacctatatgcctgcctatggtcttgcgacagcggcggcggttttgatcggtcaagccttgggaaagggggacatcctcacagttagacgggtcgcatttctcagctctgcctatggagtagccatcatgtccctgctcggtaccatcttatttttcggagccccaagttttgctctgctatttaccaaagacctagaagccgtccgtcaagtcgtcacagccttacggatcgatgctttcaaccagccaggccttgcggtttctttgatcatggctggcgctctgcagggcttgggggataccaagtcgccactctactccacaatgataggaatgtgggggctgcgcgtctcaggtgttatcgtcttaggtcagatgttcggtttaggaattgccggcgtctggctgtcgattttgattgacctgctcttgcgagcgatttttctgacttggaggtttattgtgcaaacacgaaaactggctgaataggctagttttttggtataatatcagtagaatgataaaaaggagataatcagatgaaaaccattcacacagataaggcacctgcagcaattggcccatacgttcaagggaaggttgttggaaatttcctatttgcctctggtcaagttcctttgtcacctgaaactggtgaagtggttggtgaaaccattcaggagcagactgagcaagtcttgaaaaatatcgcagcaattttatcagaagcaggaacagactttgaccatgtggtgaagacgacttgtttcctaaaagatatgaatgattttgtagcctttaatgaagtttataaaacagctttctcagcagattttccagctcgttcagcggtggaagttgcacgcttgccacgtgatgttaaggttgagattgaagttattgcagttattgattagaagagaaaaggaggggatgtcatgtcggacaaactccatttagtgattgtgacagggatgtcgggagctggtaagacagtagccattcagtcttttgaggacttgggttattttaccattgacaatatgccaccgactctcttgccaaagtttttagagttgattcgtcatagccaggataacaataagattgctcttgttgtagatatgcggagtcgatccttcttctcggagattcgagaggtgttggatgagattgagggggcagaggatttagattttaaagtcctattcttggatgcgacggatagtgaattggttgctcgctataaagaaactcgtcgttcccatcctttggcggctgatggtcgtgttttggacgggattcagctagaacgtgaacttttggctcccttgaaaaatatgagtcagaatgtcattgatacgacagagctgacacctcgcaatctccgtaaggtaatctcagagcagtttgctagtcaagataatcagccgtcgtttcgcatagaagtgatgtcctttggtttcaaatatggactacctctggatgcagacttggtttttgacgttcggttcttaccaaatccctactacaagttggagttgcgtaatctgactggtctggatgctcctgtctttgactatgtcatggagcatcaagaatcggaagagttttatagtcatttgctcggcttgatagaaccgattcttcctggttatcagaaagaaggaaaatcagttctaacgattgccgttggatgtacgggtggtcagcatagaagcgtagcctttgctaaacgtttggcagacgatttagagaaaaattggaatgttaatcgtagtcatcgtgataaggacagacggaaggagacggtcaaccgctcatgagaaaaccaaagattacagttatcgggggcgggactggtattccagtcattttgaagagtttgcgggataaggatgtagagattaccgctatcgtgacggtagctgatgacggaggatcttcgggggaaatccgtcaggctttgcaggtgacccctccaggtgatttgcgtaacgtcctattggctatgtcggatatgcccaaactttatgaacaaattttccagtatcgttttgcggattcagatggccccttggctggtcatccactagggaatctcatcattgctggtatttcagaaatgcagggttcaacctacaatgcgatgaggttgttgacgcgctttttccatacgacagggcggatttatccatctagcgaacaggccttgacccttcatgctatttttacagatgggaccgaggtagcaggtgagagtaagatttccaagcataatgggatgattgatcatgtctatgtgacaaattcttataatgatgatgaaccgaaagccagtcgccaggtagttgaaacgattatggaaagtgacatgattgtacttggaccgggttctctttttacctcaatcttgccgaatctgatgatttctgacattggcaaagccctaaaagaaaccaaggctgaagtgacctatgtgtgcaacattatgacccaacggggagagactgagtttttctcagatgcggaccacgtggcggttctcaatgcacacttagctgaacaattcattgatacagttttggtcaatattgagccagttccacaagagtatatgaatagcaaccagtttgatgaatacttggtacaggtaaaacacgattttgcaggtttgcaaaaacaagctaatcgtgtgatttcttcgaattttcttcgtttggaaaatggcggagctttccatgatggtgacttggtagtagaagagttgctcaagattttgcaggtgcggccatgagttttacagtacaagtaaaggaagaattgctgcttcagtctagccaaaataagagcgagctatctgctattatcaaattatcaggtagtttgggcttagcttcatcaggtttgactctttctatcagcacggaaaatgcaaagattgcccgtcacatttatgaactgttactccatttctaccagattaaagctgagattcgccatcatcaaaaacctaatctcaaaaagaatcgtgtgtatgcagttttgatagaagacggcgtgaatgagatattgaacgatttgcatttggctgatagcttctttggattagagacggggatttctcccttggttttggaaaatgattcgtggagtcaagcctatcttcgtggagcatttttagcggcaggctctgttaaggatcctgaaaaaggaaaataccagcttgaaatagcttctgtctatagtgaccatgccaatgacctggccaatctgatgcagaaatttcttttggatgccaaagtcattgagcgaagtaagggaaccattacctatctgcaacgtgcagaggacattatggattttcttttggtgattggagcagaagagacgaagacagaatttgagaatgttaaattgcttcgtgaggctcgcaatgacctaaatcgagctaccaatgcggaagctgctaatattgcaaagacggtcaatgctagtatgaaaacaatcaataatattatcaaaattatggatactatcggtctagatcagttgtcaggtgacttgcaggagattgcccagttgcgaattcagcatccagactattccattcagcaattggcggatagtctaacggtaccgatcactaaaagtggtgtcaaccatcgtttgcggaaaatcaataagattgcggatgaattgactgactagataggtatacatagaatgttatggacatttgaattaactttgatacatcgttactttcggcttgccgtactctagtattgcttacacctcagttccttgtctgaaagttaattcattcgacgatactaagactggttcgagaggaccagttttttgtattagttgtgatagtattcctcttcacaggaatgatcctgttttatgaatttttcagtaatgattagcatagaacgttaatatatgttaaaatagatagaaggatactttagctagaaaggagttttgatgataagcaacgaacaatatgattatctaagggcacatccaacttttgaacgtttgacacgtgatagctttgatcaattagctaagcatattcgttttcgaaagattcctaagggacaaatctttttttacgcagaggatcctagagattatctatttgtattgtataagggctatgctcggattgagcaatatgatgagacggatagttttacgtatttagactatattcggcagggtggtgcctttccttttggagatatgtttcaggacaaaccttatcattataccgccattgccataacggacctagagtattttattgtaccgatggtcttgtttgaaaccttgtcgaagataaatccgagtcaaatggcttatatctgtcaaaaattatccaaagtgcttcgttttcaagagttgcgcttgcgaaatgcgatgcgttccaaggcatcagatcgagtcgttcaagccttggctcttctttattgggatatgtgccagcgagagcagtttgctaccttgccatttgaaattcatattcaagagatttcgcgtttagcagctacgacacgggaaacggttagccatgttttgaagcaactgaagcaggatggtaaaatagcttatagccataaacagttaacttatttagatattgattatttcttagaaaatttgacagaaactcattgaagtttctgttttttataaaaaaataaaaattcatataatgatataacggaaagaattatgcagaatttagatgatataatcgataattatttataaataaggttaaaaatgtgaagaatttctcaaaataaatgtgagcgttttcaagtttttgtttttttgctctgttaaactatggatgtaaagaggaaatgagaggcaggaaagcgtacggtcctcctcgtttcccatcatgtataaatctacaaggaggacagatcatgtcaaaccatccaattcatgttttttcagaaattggtaagctgaaaaaagttatgttacacagaccaggtaaggaaattgaaaaccttatgcctgactatctagaacgcctactcttcgatgatatcccattcttagaagatgcacagaaagagcatgatgcctttgctcaagctcttcgtgatgaaggtgtagaagtgctctacttggaaaaattagctgctgagtcacttgttacacctgaaattcgtgaacaatttattgatgaatatcttgaagaagctaacattcgtggccgggcaactaaaaaggcaattcgtaagctgttgatgtctattgaagataatcaagaactggttgagaaaacgatggctggtgttcaaaaggcagaattgccagaaatcccttctgaagaaaaaggtttgacagatttggttgaatcctcttacccatttgcaatagacccaatgccaaacctttacttcacacgggatccatttgctacgattggtaatgctgtttctcttaaccacatgtattcagaaacacggaaccgtgaaaccttgtatggtaaatatatcttcactcatcacccagaatatggtggaaaagttccattggtttacaatcgtgaagaaactactcgtatagagggtggtgacgaattggttctttcaaaagatgttttggcagtaggtatttcacaacgtaccgatgcggcatcaattgaaaaactattggtaaatatctttgaacggcatgttggcttcaagaaagtattggcattcgaatttgctaacaaccgtaaattcatgcatttggatacagtatttaccatggttgactatgataagtttactatccacccagaaatcgaaggtgaccttcgtgtcttctctgtaacctatgaaaatgacacgcttcatattgaagaagaacatggtgatttggcagaacttttggctgcgaaccttggtcttgaaaaagtagaattgattcgttgtggtggcggtgatatggttgctgctggtcgtgagcaatggaatgatggttcaaatacattgactattgcaccaggtgtggtagttgtttacaaacgcaatacgattaccaatgctatcctcgagtccaaagggcttcgtttgattaagattggcggaagcgaattggttcgcggtcgtggtggacctcgttgtatgtcaatgccgtttgaacgtgaagacatctaatgccaagtatagaacgaacaacaatcggttcggaagaatggcaacgcgcagcctctatctatgtccgctataaggtatttgtccttgagcgtggtattgcaaaggaagatgaatttgaccagaatgatacggaagaaagagtttacgccaatctctttattggtgaagagcctgtttcaacgggacgttttcttcctgtcggtcctggtcaagctcgtctaacccgaatagccactctaccgaattttcgtggaaaaggctatggaaaaatgattatcagctctttggaagcgtatgcacgtgaagcaggctttcatcagttgaatatacattcggagttaactgcaaagactttttatgagtcagttggctaccaagcaacttctgaagtttatcaagaagatggagaatggtgccagacattgacaaaatttatttaaacattaggagaagagacaatgacaaacgtatttaaaggtagacatttccttgcagagaaagatttcacacgcgcagaattggaatggttgattgatttctcagctcatttgaaagatttgaaaaaacgcaatattccacaccgttatttggaaggtaaaaatattgctctcttgtttgaaaaaacatcaacacgtactcgtgctgccttcacagtagcatctattgaccttggtgcccatccagaatatcttggtgcaaatgacatccaacttggtaagaaagaatctacagaagatactgctaaagttttgggacgtatgttcgacggtattgaattccgtggtttcagtcaaaaaatggtggaagaattggcagaattctccggtgtgccagtatggaatggtttgacagatgcatggcacccaactcaaatgttggcggactacttgactgtcaaagaaaactttggcaagttggaaggcttgactctggtttactgtggtgatggccgtaacaatgttgctaactcacttttggtaacaggcgctatccttggtgtcaatgtccatatcttctctccaaaagaactcttcccagaagaagaagtagttgccttggctgaaggttttgcgaaagaaagtggagcacgtgttctcattactgacaatgctgacgaagcagtcaaaggcgcagatgttctctatacagacgtttgggtatcaatgggtgaagaagataaatttgctgaacgcgttgccctcttgaagccataccaagtgaatatggaattggtgaaaaaagcagaaaatgaaaatctcatcttcttgcactgcttgcctgccttccatgatacaaacactgtttatggtaaagatgtcgctgaaaaattcggcgtagaagaaatggaagtaacagacgaagtattccgtagcaagtatgctcgtcacttcgaccaagctgaaaaccgtatgcacactattaaagcagtgatggcggctactttaggggatccatttgttccacgtgtgtaataattaactatctaataacgcatcgcaacctccgggggctggcacccagcccccttattttgaggatagatgtgtaagcgattactatttcgcgaaagtgaggaaaaagcaagagatatggcaaatcgtaaaattgtagtagccttgggtggcaatgccattttatcgtccgacccatcggctaaagcacaaaaagaggccttggtacaaacagccaagcaccttgtaaaattgataaaaaatggggatgaccttattatcacgcatggtaatggtcctcaggttggaaacttacttcttcaaaaccttgctgctgattcggaaaagaacccagcttttccactagacagtttggtagccatgacagaaggttcgattggtttctggttgcaaaatgccttggaaaatgaattgctcaaggaaggcattgaaaaagatgtagcatctgttgtgacccaggttatcgtagataagaatgatcccgccttcgaaaatttgaccaagccgattggaccattctatacagaagaagaagcgaaagcagaagcagaaaagactggtgcaaccttcaaagaagatgccggtcgtggctggcgtaaagtcgttgcttcgccaaaacctgtaggaatcaaagaaattggtaccattcgtacccttctcaatgcaggtgaagttgtcgtagcagctggaggcggaggtattccagttgtccaagaagcagatggcaccctgaccggtgtggaagcagttatcgataaggactttgcttctcaatgtttggcagaattggttgatgcagacttgtttatcgtcttgacaggtgtagactatgtctttgttaactacaacaaaccagaccaagaaaaattagaaaccgttactgtggctgaattggaagaatatatcaaacaaaatcaattcgcaccaggttccatgctaccgaaagttgaagcagctattgcttttgtaaacaataagccgcaatcaaaagcagtcattacctcattagaaaacttaggcgctttgattgaatccgatagcggcactatcattgtcaaaggctaagcagctgtatgtatcgttgaggcttctatttattgatgtactctgcatgcaaatatagtttttaaactagacgggttatttattgatggagttaggggagtggaagtgttgatagtcccacaagggttccctttaatctaaacatgaaggtctgggcgtctaagctccctcccctctcatccatttcctatcaagtatctatctataagcaatgatttcagataatagactgaaggagatagacatctcttgaagataggtggatatttgatacggttattacggatacaatttcccttaaataggggataaacttttaaaatattataggaggtttttgcgatgagcgaaaaagtgaaaaaaggctttaaattgccttcgtcttatacaatattgatgctcattattgcctttatggcagtgatgacatgggttattccagctggtcagtatcaggttgatgaagccggacgtttggtggctggtacctatgagaaggttgctcaaaatccacaagggatttacgatgtttttatggctccagttcgtgccatgcttggtcacggtgcgactgaagcagcgattaacgtagcattcttcatcatcatggttggggcctttcttggtgtagttaacgaaacaggtgcacttgatgtagggattgcttctattgtaaaacgcttcaaaggtcgtgaaaaaatgttgatttacatcctcatgcctttgtttgccttgggaggctcaacctatggtatgggtgaagaaacaatggctttcttcccgctccttgttcctgttatgatggcggttggttttgatagtattactggtgtagccatcatcttgctaggttctcaaatcggctgtttggcttctactgtaaacccatttgcgacagttgtagcctctgacgcggcaggtgtaagtgttgcggatggtatgatttggcgctttgtcttcttcgttgtcattctcgcgatgggggttctctttgtagccaactatgctgagaaagtgaaaaacgatccgactaagtccttggtttataaacaacgtgaagcggacatgcaacactttaatgtcgcagcaactcaagaagtgaatgcagaattatcaccagctcaaaaacgtgttctctgggtatttgtactaacatttgttctcatgatttgtagctttattccatgggaagatttgggtgtgactatctttacacaatttaatgattggttgattggtcttccattcatcggtcaagtgattggttcttcaacagctgctcttggtacttggtacttcccagaaggagcaatgctctttggtatcgcagggattgtagttggtttagtttatggtatgagtgaagaacgtttggtaaaatccttcatgttcggtgcggctgatattttcagcgtagctttgatttgtgctatcgcgcgtggtattcaagtcatcatgaacgatggtatgattactgccactattctccacatgggtgaagaaggattgcaaggtttgtcttcacaagtattcatcattttgacatatctcttctacctaccaatgtccttcttgattccatcttcatcaggtcttgcaggggcttctatgggtatcatggcacctcttggtgagtttgtaaatgtaccagcgagcttggttatcacagctttccaagctgcatcaggtctcttgaacttggtagctccaacatcaggtattgtaatgggagccttggcacttggtcgtgttgaaattggtacttggtataaatttgtaggtaagttaatcgtaggcatcatgattgcctccatagctattttggtcattgcgacattcttctaatcgaaattctgggtcagattttatcacgaatacagataaaatttggctcagtttttccttttatgatagaatagtgctagaaaatatatcatatcttattatgttgaaaggggacacaatgagaacaagttttattcagtcatcgcatcaggaggcatgtattcaagccatccaagaactggttgcttttccttctgttttgcaagaacatcaggcagatacgccatttggtcaagcgattcaggatgttctggagcacacgttggctttgacggaaaaaatgggttttaaaacttatttagaccctgctggctattatggctatgctgaaattgggcaaggcgaagaattattagcaatcctttgccacttagatgtggtacctgctggtgatcttagtcaatggcagacgccgccttttgaggctgtggtagagggagattatattattggacgcggggttcaggatgataaaggtccttcgatggcggccttatttgcagtaaaagcacttcttgatgcgggagtccaatttaacaaacggattcgtttcatttttggaacagatgaagagaccttatggcggtgtatgaaccgctacaatcagttggaagaagtggcaactatgggctttgcgccagattcttccttccctttgacttatgctgaaaaaggattactacaggccaaattgcatggtccaggtcacccttgtctgagtatcgaagctggaactgcctataacgtagtacctgccaaggcaagctattccggtcatttattagccggagttattgcggaattagatcaattaggctttgattatgaaatcaaagatgatcaagtaacggttcttggtatttcgcggcacgccaaggatgctgccgagggggtcaatgccatcgttcgtttggcaaaggctttggaacatttcgaaaatcatccagccttggactttatcgtcaatgcagttggtgaagatgccacaggatttaagctttttggtgatgtgaccgatgaaccatcagggacactcagtttcaatattgcaggtctaaccattagcgcaaaaaaatcagaaattcgcttggacattcgtattcctgtcactgcggataaagaagccctagtttctactttacaagccaaagcgcaatcatgtggcttgacctatgaagagtacgactaccttgcttccttgtatgtgccattagacagtcaactggtatctacgctcatgtctgtttatcaagataagacaggagatttgacaagcgagccaatctcgtcaggtggggctacctttgctcgtactatgccaaactgtgtggcttttggtgcatgtttcccagatacagaacaaacagagcatcaggaaaatgaacgcatgccattagaagacttatataaaacaatggatatttatgctgaggcagtctatcgcctaactgcggaatagccattatcagcattgaatagtaaattacagtttaaaagctcttagtgaaatatctaagggcttttcttatgaagaatatcattaaaaagatgagagagaaatgtgtcactgtttacaagaagtggacaaaaatatatgaaagtgtgacttattatatgctgttttagaaatagaccccatctgcatatagaataagtcaagttggactattctacaataaaacgcttacatgttatatttgtgacagaaatgcgatcgcacatcaaccagtaaactgaattttgagtcttgtacgagactaaataggtttacaaactgctttattttggctataggtaggataaacttgcagactttataggaggaaataatgaaaaaagaaacaagtaagtttacgaaaaaagtcatccttggtcagcttctcatctgtaccagttttttggtatgggcagggcagactgttgcagcagaggaggtatctcagggagaaccagtagcaatcaacaatgaaactccacctgttattgaagcaaaaccacttgtagaagctactccatcaactgaaacagaaccttcaactccagaagaaaaacaggaggaaccacaagtagctggtaaaaatgtggtagaagggaaaaagccagtaaccaacagccagcatcagatggtttctgaattatcaacggtcccttctgtttctataaaaaatccagatgcagctaccgatgggagtgcttacggtagtagcgacgatgccaatagcaataccaaaatcattgctggtaaagaaactggcgaaccagataacggttactccaagtgggatcatgtttacgttcagtatgattttgaaaaggaagttcccgtccatactgtaaaaattcatcgtaatacttatgacaatgcagtgtctacttttaaagatgttaaagtggaattgtctacaagtgcagatttttctcctgaaaccacagaagtcattttcaaacaggcagatgtagaagaaacaattgcaaataaaggacagcctcaagtcatccaattaccagcaccaatcaatgctcgttatattcgtatttggggacgggggcattatatccaaaatacaaacagttcctggaagggatatagtaatggcgttctctttaacgagatagaagtcttggcgcaggttgaagcagatgctggtacgaatgaagaaccacaaaccgagctagtcaacctcgctaaattgaaaaaaccatatttctatggtaaggctccaactaatccagaagccattaacgatggaaagttcgacgagaattatactactcaagaatcaataggggataaagcttatcttcaatatgaatttagaaatgtctatactattgaggaaatcaaggttcagttagctcctggagagtatcgtaatttccggatagatttggatgatgattataatgatggtaataattataatacaatctataagaatgaaaatttcaccattgacaaggaacagattataacaattaaaactccgaagaactctaaagcgcgttatgttcgctttagaggtacgcgcgtagatgatactcctcttcgatattcagaaattcagattatgggacgaggaaaatcttatgacgaatctgctccagaatatgttccaccaaaatctgaatacgatacattagtctggtctgatgaatttaatggcgacaagattgatgaaagtaaatggcaaattattgatggcatgtggaatcatgcggctatatacaatcgtaaagcagtttctatcaaaaaagatggcgacaagagctatttgtctatccgtagcacgaaccataaggataaaaaaactttggttgaagcagttgggcacgatcggtatgatgataaagaattaccagataaagtaacatggtcttctggtcgcctagaatctaaagataagtattctttccaatttggtcgaatggctgttcgagctaaggtaaatgactctaagggaatctggcctgctatttggatgttggcacaggatgagaccgggcatgacgaaattgacgttttggaataccttggtcaaaatccatggtatgcatggacaactaaccattttggtattttggcaaaaaataaaaaatctgatggctcagcttataagaattacgaagcttggagtcaggaattccatgtctacgaagtcgaatggactccagatgtcatcaaatggtatattgatggaaaatttgtttttcaaacagaccgtggtaaggatcgggatggtatgcacacccgccctatgttcccgatactggaaacccaagttggtgatggctgggttggtgatgttgattacaaacgcaacatgactaaacaggatagtgagtacttggttgattgggttcgaatttatcaaaaagcagatcaaagtaaggtacgttttgataatctagatgatgccaagcctaatgattatgttattaagccgcagcaaaaacttggtcacctcgtaacagtctctaacgggaaagcagctcatgaaaacaaaaataatttctactatggaggtcaaccacgttacgaaacaagcaggctctatgctgatggtgatggcgaaaatgcactagtctacaagattgctaatccagaggctttgcacttaacgacttattacaaaacacttgaagactattctgtctataataaagaagcaggggctaatgaaggaaaatctgttcgcaaacatttgataaatgcaaaagacggtgaaattgacttcactgtgtattcatctgttgacggcaaaagctggaataaagagaatgttactgtagtggataattttgtagaagcaaccccagcttatgcacgcactacatttgatattcgcaacattcgaaaaggtactaaatttgtgaagatcgtctttccaacggttaaaggtatttcctataagttggaagatggaacagagaaaggcttgcaagccagtgatgtccagttagcaaaagtaacttttgtagctactcatcctgaagcagaaccagaaaaacctattgttgatcaagaaaaactagccttgtccaaagttttttcactcgatgccggtcgcaagtatttctctgtaaatcagataaaggagattattgatttaatttcttcttatggttacacggatatgaacctcttattgggaaatgatggtctgagatttttattagatgatatgaatttgaccgttggagataaggtgtatgacagtgaagcagttagaaaagcaataataaatggtaataagcattattatgacgatccaaacggtacaaccttaagtcagagtgagatggatgatattcttgcttatgctaaggaaaaaaatatttccattattccaactatcaatagcccaggtcatatggatgcgattgtagaagcaatggaagaattggggataaaatcgccaaaatttagttataatggcaaaacatctgcacgtacagttgatttaaaaaatgaccaagcagttgcttttactaaagccttaattgataaatatgctagttactttgcaggcaaatctaaaattttcaatattggcttagatgagtatgctaacgatgctacaaatgcttctggatggcacattcttcagacacaaggtgattatggtaagtttattcaatatgccaatgatttagcagctatcgtcaagaagcatggtttagagccaatggctttcaatgatggtatctattataaccacgatactagttcgggtacttttgataaagacattattgcttctttctggacaggaggttggggaggatatgatgttgcttcctcaaaattccttcatgaaaaagggcataaaattcttaatacaaatgatgcttggtactatgttattggacgtgaagcagaaggtttgggatggtataaccttgatcaaggtcttcgaggaactaaatctacaaggtttgatcaagtaccgaaatctgagaatactaaggtacccattattggtagtatggttgcggtatgggcagatgacccaagcaagccttacagctatgactcaattaaaaaacttttgcacagttttacggaaaacaattctgattattttttggcagagtaccgagatttgcgagaagaagttgggaagattcctactgatttaaattcctatacaccagagagcgtggcgactttaaaagaggtcttgaacaagattgattggaaactaagtagaaataaccaagcgtttgttgatggttacttggcagaagtaaaagcagcgcgtgaagcgttagttcctgtgacagcaaagggagacagcgtcaaagcggagcccttaccagaaggcaagctacctctgattactgctaaaggaaaaagtgtccaagcagaaccacgccctgcctttaagggatacctgacatcaaactatggaccatctgtcacacctttatccctcgtatcaaaaccaagcagtgagcagtcaaattccaagcaagcagcttctcagaagaaagaattgccaaatacaggagtagtagatggtcttggattctctctccttgggatgattggtctggcatttgctagtcgccggcggaagaaggagtaatgtagccacttgaattaaggttcagggctttctaattgtaattatatagttatctagtttttctttcactcgctttgctgtacccaagtatagcatgtagcttattgccttgtacaaaaagtaaactagaaagctatgaataacaggataattttttatcggctactaaaaatcccccgtaataaatcttattacgggagattttcgtttatgagtataaagggaagttattgatatttatttgaaaaattatctttaaaattaagtatgttgtttgtgaacacaaatttttataatttactaaagaaaaatggtggagtaaactgtttcaagtgctcgaagcaagcttgtgccccctcgacatcttcacaaatgatgagacagacatcgtcaccgcagacggtcgctacaatttgaggaatttccatggcatccaaaatagaaccgaatgagttggccaatccaggtagggtcttgagcaccacttgatgttggataggttttagcatgaccaaagcatcttccatatagagtcgcagtcgtttttcccagcgagtaggagcaatggggttgatgacatagtgagaagaatcatcttcgttgactttgacaagattgagcatcttgatgtcacgggagagggtagattgggtgacggagactccgttgacctctagtaattcttgcaattcctgctgggtatgtattttcttctccatgattagagataggatcagctgatggcggctttcaatcttgttcatagggccctccaataaaatcagaattcagaataatttggtgataacagcctattgaatgaacattgcatccccaaaactaaagaagcggtagcgttcttcaacagcatgtttataggcatctaaggtaaattctctacctgcaaaggcagaaactagcataaccaaagtagattttggcaggtggaaattggttgagaaggcatcaacgattcggaaggtgtagccaggtttgatgaagatatttgtccaaccagaatcagcttgcaaacggccatcaaatttattaccgatggtttcgagggtgcggatggatgtcgtgccgactgcgacgatacgaccaccgctatctttgacctgattgagggtttgagcagcttctgctgataggttatagaattccgagtgcatttcatgctcatcaacgttatcaacagagactggtcggaaggtcccaagtccaacgtgaagagtcaaatagactagcttcactcctttagcttcgattttttcgagtaactcttgggtgaaatgtagtccagcagttggggctgcggcagaaccgttttccttggcataaactgtttgatagcgttcacggtcttctaatttctcatgaatgtaaggtggaagtggcatttcgcctagactttccaagacttcaaggaagataccttcataggagaattcaacaattcttccaccgtgctctaattcttctacgatagtagcagttaatcgtccgtcaccaaaagcgactgtggtaccgaccttcagacgttttgctggtttggcaagaacttcccactgatcaccttgggtatttttcaaaagcaaaagctcaacatgtcccatagtttcaggcttgtagccatagagacgggcaggcagaacacgcgtattgttcatgaccagagcatcaccgggattcaactggtcgatgatatggtcaaagtgactgtcaaccatgctccgtttttcgcggtcgaggatcaatagtttagagctgtcgcgcttttcaaggggtacttgagcgataagctcttcgggtaaatcaaaatcaaaatctgcagtattcatattcactccttagactaaaataaaatataggtaaaataaatcaatagggcaaatggcaaagccaccaatagaccaccaatcaggtagaaaataaactttaggacctttgatttagaaataaaatagccagtaaggcagaacagaataccaataaaaaataagtaaaaaagcacatctgtcataaatgtattatatcatagttagacacttaagtcttgatggatgggaagagaattaaaattattcgtgctgatgtaatactctataagtataaattcttgacaaaaattggtctataccatataataaagaaaaacaaaatggtatagaccaaagaggtgtgttatgaaaattcatgtagtaaacaatcaagttgaaggagcaactgtagcattagacattttgagagaaaaattgaacggaggtaccaaggtattaggtttggcaacaggctccagtccgttagaattttacagattgattcgtgagtcggatttagacttttcggatgtgacatctgtaaacttggatgagtatgttggtttaggtgaggagagcgaccaatcctatattcattttatgaaggaaaatcttttcaataccaaaccgtttaaacaatcttatttaccgaatggtttggcgacagatgtagttgctgaaacagaacgttacaataaaattttggctgaacatccggttgatttccaaattttgggtatcggtcgcaacggccatatcggtttcaacgaaccaggtgctccatttgatggtcagacccatctggttgaattggcgccatcaaccattgaagccaacgcccgcttctttgacaatccagaagatgtaccaaaacaagctatctccatgggcatcgccaacattatggcagccaagaccattgttctcatggcctatggtcaggaaaaagctgacgccattaaggcgactgtggaaggggcagtgacagaagatgtcccagcaagcgtcctccaaaaccatgacaatgtcatcctcatcctcgaccaagcagcagcgagtaaattagtgtagtatgttgtaaacgattattcttagacataaagttggttgtaacagtacaataagtataatttctgaatgaatctaggttctttttccattatgaatttgacaaaaattgtgaaaaggcatgtaacttatatttttaagggcatgccttttgctattctgataatccatatcagttgttatatatttgaatggattatatataacattaagttggatgtgagagaaaatttcaacaagaggtattgccatcctttatcatgttgaaaattgatagggataagtgaaatgggcgaaatagtatcattttctctacgttttgtataacgttttcaattttttcaggtagttttctggtttttatataatctttttctaaagttggtttttgagttatttttttgtgctatactgttactacgtttccgataggaggaagcaaatatctatacaaaggagatgtttcatcatgaaacatattgtaacaaaacgtaattataaagttggcgcatgcgctatggcacttgcattgttgatgactactgcaggtggtgcagttgtaaatgcagagcagcaccttgagtcatcagttggcttagtacagcgtggtgatgtacttctaaaattgaaagaatcaaaccagtctttcaatgaaggagaggttggaaatttagagcctgtcaacccaactgtgcctccaatggcttcttctgtacaaaaatcatggtttagttcattttggggtggtgtaaaaacattctggaatgcattatgttgttctgtgggactaactgggctcaaagttagtaagtaacatagagttataatcttgtaatatttagttaattaatttgcaaatccttcatacttcactagctttcttaaattatttaattttctatatattaccctcttagaaatctttttcatctatacattcataactttaataatataactcgaattagtatgccctctatgaaaatagagggttttaaacattttttctttattaccacaattattcgatacaagttttttgaaccataaatataatattgcatgtgtatttttgttcttgtgttaatatgcatatcttggagttttatagttttttatctaacctttttctaaagttggaatttgagttgtctgtttgtgctatactatcatttgtagagacgaatatcgtataaaggagatatttcaacaatgaagcaacttgtaacaaaacgtagttataaaattggtttgagtgctatggctttggtcttgctaatgaccactgcaggtggtgccactgcacatgcaagtacgggtacctatagtgtcgaaactcgaggtgatgccaaagtgtataggctgttggaaactccggcggggtcttttacacaggggggcatagttttgaaacctgtgaataattctacaactaaaccatctgaaaccaaatcatggtttgattctttttggagtagtgtaaaaacattttgggaagcaatctgtcgtggagttggatggtgttaagtagaatgtttactatttagagttatattcttgtaatatttagtcaattaaatttgcaaatccttcataccttcattaatctttcttaaatttttaattttctataatattaccctcttaaaaatctttttcatctatacattcataactttaataatataactcaaaatagtatgccctctgtgaaaatagagggttttaaattttttagggatattcttttttattacttcgcttattcgagacaaggttctcttgaaaggagcgtatcctatttcctagtttttatattaatatttttattttttggaatttaatggttttttatctaatctttctctaaagttgggatttacgttatttttttgtgatatactggcactacattgtctaaaaaagggcgaatattgtataaaggagatatttcaaaaatgaaacgtattgtaacaaaacgtagttataaagttggtctgtgtgctatggctcttgctctgttgatgagcactgcaggtggcgtaactgctggtgcacaggggcataattttacttcatcagatagctctgcaatgagaaatactcaggtgcttgttaagggaaatacatcaaatcggagttctcatgatggtccagtaaaaattgcgatgccgagagctgctggttctaaaaaacaaaaaacttggtatgaatctctttggagtaccattaaaaagttttttgaacaacttcgtcatggttttcatttagaaagactgtttaaaaatggatagtaattcagttttgatttattaatctattaataatcttataacatttagcgcaattaatttataaaccttcatattaaaaaaactaatactttgtaaaaggagacatttcatgaaacaagctaattcaaaactagtagctttaacactcattacaactctcgcagttacctctgtgattgcgacaacggtgcatgctgaagagaaagtaactgctgatcagactgtagcaggaaaacacaaaccgattacgggtgagcagcttcaaaaagcgattggagatagaaatccaaatagtattcagatacaagctaaatttgaaaataccaatttcaaaaatcaaggaataacttttattggaaaagctgaaattccatctaaatcttctgaaaagtcttcatggttttgggaactttggactcgttttacaacttttgtcaaaggtatttttagctaaggtttctatttttcgttgacttcatatggatagagaacagtggttcatgtgagcttttattcaaatgaaaagcgtatgaaatattggagagatctaggcatctaaactagagattgtgcaagaaattatgtaatagacctcacattttttgcgaatgagatgttgacacgaattccatatttcttgagtctcagttgtaatttttcttagataaattaaagagtgaaaagtttaggatgtaattgttctaaactttttatattgcattgataaaaaaatacagtctttgtgtaacaggtatattcttgtattttttagtgaaaaaagaaataaattgacaaaattatggtaaaatataggttgatttaaaattaatcatctaatgaatggaatgagttcgaagtaagtcaagattgactagacattgtatttaaagcaattcgcaggaataagagatggaaggagatagaacatgcaacatccagttgtacgatttatctgtagaaccctgttctatttttttatattgttactacttttgtatctgtatagttatttagacattggacagggaggatttatctataatgagttttaaagaggagagtataaaaatgattagcagtatgttagagcgggtagagcattttgcgacagaaaatcctgactaccctgtttaccattatctaggacagttgtatagttatggggatttaaaggcagattcagattctttagcagcccatattgatagtttggatttaccagcaaactctcctgtccttgtttttggcggacaggagtaccagatgttggcaatctttgtagccttaaccaaggctggccatccgtatatccctgtagatagtcattctgctttggatcggattgaagctattctggaaatagcagagccgagtttggtgtttgcggtagcagactttccgctagagacaagtttgccagtgcttggtttgtctgaagttgaagccatttttgagaagaagtcgacttatcagttgatacatcctgtaagcgaagatgatacctactatattatcttcacttctgggacaacgggtaaaccaaaaggagtgcaaatttcgcatgacaatttgctcagctttactaactggatgataagggataaggagtttgcgctaccagagcgaccgcaaatgttagctcaaccttcctattcgtttgacttgtcggttatgtattgggctccgacgcttgcccttggtgggaccttatttgctctaccgaaagagttgactttggattttaagactttatttgcagctattcaaactttgccatttaagatttggacttcgacaccatcatttgtagatatggctttgctatctcgtgagtttgatggggaacatttaccagatttgacgcatttctattttgacggagaggagttaactgtaaaaacagctcagaagctccgcgaacgttttccaaaagctgtgattgttaacgcttatggaccgaccgaagctacagtcgccttatcagcagttgccatcactgatgagatgctggtgaattataaacgtttgccgattggttataccaaaccagactcgccaacttttattttggatgaggatggtcaagtagtaccgaatggtcaacagggagaaattgttgtatcaggtcctgctgtctctaaaggatatttgaataatcctgagagaaccgaggcggcatttttccagtttgacggcttacaggcctatcatactggggatttgggtgtaatgacagatgaaggtctgttactctatggtgggcgtatggatttccaaattaaatataatggttatcgtatcgagttggaagaagttgcccaacacctaaataaatcaacctatattgaggctgcggtggctgttccacgttataatgctgaccataaagtgcaaaatctgttagcttatgttgtccctaaagcagggattatggagcagttcgatcgagagttggagttaaccaaggtcatcaagcaggagttaaaagaacggatgatggattatatgatgccttcgaagtttatttatcgagacagtcttcctttgactgcaaatgggaagattgatattaaggggttgatcgctgaggtgaatgctcaatgatggagttttttaaacagctacctcagttagagccttatggaaatccattgtactttttctatctagtcttggcgctagtaccaatttttataggactcttttttaaaaaacgtttccccttgtatgaaacaggtgttagtttagccttcattgtcttgatgtttacaggtacaaagacaatgcaattgctgtctttattggcctatattatttggcagacaatgttgatttttttctacaagcattatcgtcaacgggcaaatcaaagctgggtcttctatctaatcgtgtgtttagctgtttttccgttgacttgggtaaagttggcaccgacttttagtcagcatggggcaattttcggttttttaggtatttcttatttaacgtttcggtcggtcggaatggtgattgaaatgcgggacggtttactaacggaatttagtttgggaagttttttgcgatttttgctatttatgccaactatttcgagtggccctattgatcgttatagacggtttacggaagattacaaacaaattcctgagcgaactgagttattaaatatgctcgatcagactgtgcattatattatgatgggcttcttatataagtttattctagcctattttatcgggcatactttactggagcctttaaaggcagtagccttggatcaaggtggatggtttaacttacctactattggagttatgtatctttatggttttgaattattctttgactttgcaggctattccatgtttgccataggtatttccaatcttatgggtattcgctgcccaattaactttgatcaaccgttcaaatcgcgtgatcttaaggagttttggaatcgatggcatatcagcttatctttttggttccgtgatttcgtcttcatgcgtctggttaagactttgttgaaacataaggttttcaaaaatcgaaatacggtatctaatgttgcctatctgctaaatatgctcttgatgggcttgtggcatggtgtaacatggtattatattgcatatggtctctttcatgctttggggttgatcatcaatgatgcttggattcgtaagaagaaatcaattaatttagctcgaaaaaaagctgggcaagaaccattgccggataatcgttggacgagtttcgctggtatgtttgtgaccttccatacggtcatgttctctttcttgatattttcaggatttttagataaattgtggttcaagtagacaataggtaacgattgtatgaatcgtagaaaggaataaaaaatggatgtaaaagaaacaatattgaatattatcgaagaattatttatggaagatgtatctgaaatgatggatgaagacctatttgatgcgggtgttttggatagtatgggaactgtagaacttattgtggagttagaaagtcgttttaatattacagttccagtttcagagtttggtcgtgaagattggaatacagctaacaaaatcatttctggtgttgtggagttgatgcatgcgtaagcaattgtggcagatttttggacctgtgatttgtgcaacgtttttagttattctcacgttgttgtttttcccgagttcttctcggtcaaatttcaaagaagaaaaacaagatgcagtagcattgtcttatattagttttaagagcaaatataagaaaaatagggctctgggagataaaaatcatcgttttgttcctttctttgggtcaagtgaatggtcacgttttgatagtatgcatccgtcagtgttggcagatgcctatcagagagagtatactccctatttgttaggacaacgtggtgcagcttcgctgacacaatattttggcatgcaacagattggggcacatttaaaaaatagtcaggctatctatgttgtttctcctcaatggttttcacccaaaggggcatcatctaaggcatttgaacaatattttagtagtgatcaagccactcattttctgcaaacaagtgctaaggatgactatgatagatatgcagcaaagcgtttcttagagcttaaatcagactgtagtttgacaggaatgtttcaaaaagtagctagtggtaaggaattgtcgaaatgggatagagagcagttgaactggcaagcctatttattagaaaagcaagatgccttatttagtcgctttgctgattctggtagtaatttaggattggtagaaacggaagcgatgaaacttccagagactttttcctatgaccgcttgagtaaagtggctaatgaggacgggagtcgttctactcaatcaaatgatttccaaattgatgataggttttatagaaatcgtcttcagtcaaaaatcaaaaaactcaaacaatcccagacaaaaatatcttatctgcaatcaccggagtacaatgattttcagctggttttgaatgaatttgctaaacatcagactgatgtgctatttgtaattcccccggttaatgaacgttggatgaactacactggtctcaataaagatatgtatcgggcaacagtagcaaagattaagtaccagttgaccagtcaaggtttcaatcatattgctgatttgtcggagcagggggggatagattattttatgcaagatacgatccacatcggttggcaaggctggctggagcttgataagtatgtccacccattcttgacagaacaacaagcacctgttcattatcagttaaaaaaagaatttttaacttccgaatgggctgcatataagggagatttaaacttatttttgaaatagttagatacagttataataaaaagcaagaaggctttgaattaggaagtctccttgcttttttgttcttttactgtaataaactgaatgattacatatcttctcccaacaaactgtggttggctttgccgaagcgaataacatgataggcaaccatagcgtgtgagagcaggtttaagataacaaatagtaggatatttgaatgaccatccagcaataaggcaacatttccaattagtaaaatgagagcatagatgaacagccctctcctgccaacttgatggacttgttgattatagaaggaggtcgaaaggataccactatagaagataaggtttcctacaatcagcatgggcaaggccaaatcattatgatgactagggaaaagctccattgccactgtgaagaaattcaagccaagaacaattaccaagtgagcgtatagcagaacagtcgcatctgccttgcggtgatggtcgatagtgagataggtttgagaaatatagaagatgaacagagtcgccattgcgaagaagaggaggattccttccaaaggaagttctagaagcgggtaatttttgataatagctatgacgatctcaccgaaagtgataatggtaatcagctggcaacgttccaccatgtgtgggaagttgatggggtcatgactcattctcttttggaagaagaaggaaatcaagaagggaataatatagacaatcagcatccgttcatcattggtccatagcttgaagatgaccaacaaggttgcaccggcaaagacaacaatataagtcgccagcatctgcaaggttgccttgatgtcctcattaaagccaatccgtcttcctcttaagtaatattgtaggagaataatgacataagacaaggttaaaaaggtgttaaatggcagagctgtttgtgcaaaatcgttgctaaaattaagtgacatatttccaatcagatacatggatggaataatggtgaaaatatccagaaaatcccgttcgccgtatttattgagatagatggtttcattcatccacaaggtcataataatcaagtttgtagtgataaatgttgtaacttccttgaaaccgatgtggttcccatgtagcaagccagtcagtgaagaagtggccaggacaaagaccagatcataaaataattcataattggaaacacgttttgctgtaatttcagacatgtcaatctccttttaaaaaaatctgaaatattataccatacgaaaagggaggatgtcatctctctttatatcttatagtgtccagtccaagtctggtccgactgggacaatacctgttgggttaatggttttgtggctaccgtagtagtgctgtttgatatggtcaaagtcaaccgtctctgcaatgccagcatggttgtaaatccgtttggtataattccacaagtttggataatcaaccaaggccttgatattgcatttgaaatgcccaaagtaaacaggatcgaatcgcaccaaagtggtaaagagtcgaatatcagcctctgtcagctgattgccaaccagatagttcttatcagccaaatgctcttctagtttatccaaggcagcaaaaaggttcttgacctctttttcatagactgcctgactggttgaaaaacctgccttgtagactccgttgttgatgtttggatagacaaaatcattcatggcatcaatctcggcttgcaggtttgctggataatagtcatcgtaatttccagtaatatcattaaaagcagagttaaacatgcgcatgatttcagccgattcattgctgacgatggtattggttttcttatcccacaagacaggcacggtcacccgaccagaatagtgtggatcagccttcaaatagacctgatagagataatcgctgttaaagagggtatccttgataacaccaggaccatcttcaaatgtccagccattttctaacatgaggggatgaacgacagacaaggaaatatggtcttccaagcccttcaattttcgcataatcaaggtccgactagcccaaggacaagccagagaaatatagaggtggtagcgaccagactcagccttaaaaccaccctctcctgttgggcctgcctgtccgtctggcgtaatccagttgcgaaattgtgtgacgctacgaataaacttaccgcctgttgacttggtgtcataccattgatccacccatttgccatcttgtaaaagtcccatgaattttctcccttactgaaaaaatgggaaatccaataggatgattggatttcctttgtaaaaaaatatatcactaactagtattataaacttttttcaaaaagagtcaagctatatgatttgtgataaaatagtcccatgagattggacaaatgtttagagaaagccaaagttggctcgcgtaagcaagttaaaaaacttttcaaagcccagcaaatcaagattaacggacaagcagctcaaagcctaagccagattgttgacccagagttacaaactatccaagtttcgggtaaaaaagttgccttagaaggttccgcctattatttgctccataaaccagcaggagtcgtttctgccgtgacagaccaggagcatcagacagtcatcgacttgatttctccgcaagacagtagggaaggtctctacccagtcggtcgcctggacagggataccgaaggcctagtcctcattaccaacaatggtccgctcggttatcgcatgctccatcccagccaccatgtggacaaggtctactatgtggaggtaaatggatgcttggctgaggatgcttcaaaattttttgcctcaggtgttactttcttggatggaacacggtgtcagcctgcagatttgactgtcttggaggcttctttggaccatagcagagcgaccatcaagctggcagaaggtaagtttcatcaggtcaaaaagatgtttttagcctatggtgtcaaggtcacttatctcaagcggatttcctttggtggttttgaactgggggatttggaacgaggtacatacagacaactcacaccaaatgaaatggaacatttattcacttattttgactagaggaggatatataatgagcatttatgattttacagtacaaaaacaagatggcacagaccagtccatggctgagtatcaaggacaagttttacttatagtcaatacagcgccaggttgtggattggcaccacaatacaaggaactacaggagctatatgatagctataaagacaacggttttgtagtgttggatttcccttgtaatcaatttttaaatcaggctcccggttctgcggaagacatcaatcagatctgtagcttgaattatggtacaacttttcctcgttttgctaaaattgctgtgaatggatctgaagctagtccgctatatcgctatcttaagaaagaaaaatcaaccttattaggaggtcgaattgagtggaattttaccaagtttttggtggatagacaagggcgtgtggtcaaacgatatttaccaacaactagtccattaaaacttaaagaggatattgaactttacctagaaaaataacaagaaggctggagtcatctagccttcttgttttagtaaccacagaaaatagggagcgccgataagggagacaatgatgccggttgggatgcctgttccgacaagtagtactcgtcctatggtatccgctagaagtagaatgaagcttcctattatcatagtagctggaatgatgacacgatggtcatttcctaaccatttgcgcactatgtgaccagcaatgagaccaacgaaggtgatattaccaactaaaatgacactaagagaggctagggcggtagccaatatcaaggtaatccgcctttcacgctgtaagtggagccccaaagccatggctgtctggtcgtttagattcataatattgagtgagcgacttcgactaaacgttgccatccacaccaatagaagaagaggagtatagattgcgatagttttccaatctccaccatttactcgaccgctgagccactggacaatgtattccatcttaaagtcatctaattggctgatgatgctgaccatgataccagacagcatgctcgaaattccaactcccgtgataattaagcgtgcaggatggataccgtacagcttcttacgtgcaatccagtaaactagaaaaatggttaatccaccgcccatcatagcaaatagaggcatgagactcaataagacagggctgatttttgaagagagaccgacaaatagtgccacaacaagaccagctcctgcgttgattcctaatattccagaatctgccagaggattgcgggtcaaagtttgtagcaacaaacccgccaaagccagagaagcccctccgataatggaggcgattattctaggtaagcgaattcgtccaatgataagtagagtcgatgaactggcacgcccactcatgatgtcgatgaaatccgaaaaggatgaattgctatagccgatagataaggaaagtaggaaaatgataaataaaaggattagcaggaatgtgaatatttttagatagttgtgatgtcttatcaaaagtgtttctcctttctaatcaaccataggaagcaagggagaccaatgatactgatgactgcgctaatgggagtttcaacaggtggattgatagaacggcaaaccaaatctacccagatgaggaaactagcccctgcaaaggcagttaatggcaagagtagcttgtaatttttccctgtaaacatgcggataaagtgaggaataatgagcccgataaaagaaagtgagcccacaagagctaccgcagaagctgagagtagaaggacaattcccaacaaaaccaaggtcatcagtaaggttcgttgacctagatttttagcaacggtttcgttgagactcaggatggtcagctgatgcgaaaagagttgagcaaggatgaggccgatgatgataagaggagcaatgatggccagcatcttccagtttacctgtaccaatcccccagcttgccagccaatcactgcagttgataaatcaaagtagatagtaatagcttgaccaatagcagaaaatagacttgctaccatggcgccagataaaattaaacgtagttgattgtagcctttttgcacctgataagctagaccaaagactaggccggctgccagacaggagcccagtaaacatattaataaaatttgactgtagtgcaaaccaccgaacagagcataggcaacaatgagagcaagtcctgctccagcattgattcctaataagccaggatcggcaatcggattgcgtgtaattccttgcatcattgccccagcttgggccatggcagctcctaccaagatggcggctaccattctaggcaagcgtaaatcgatgataacatcctgagcggaagaatttgtcagtggatgctttagggtttctatcagttgttggtggctataagaaatagctccaaagcgtaaactaagatagactccagctatgaaagaaagacagatgatgaaaaaaacaagccaaatattctttggctttgttttgggataacgagaacttactagtttgttcatatatccagtccttttactgaagtttttgaatttctgagacaaaggcgtcaatttgtaaatctaaagacatcggatcggagaagtagaagaggttatagtctatctcgatgacgtgaccattctttacagcaggtagatttttccaaatatcactttctttgagagaggcagctgcttcttttgttttatcattgacgttaacaaggacatagtcgccaacatattctggaagagcttcttgagataccccaaaccagccttctttattgatgatgtcttcttgaacctttgcaggagcggcaaaaccgagagcgcgatagattaattctccaccacgaccaaagttattaccataaaggaagatgttcttatcgaagaagtccatgacagtaaatgttgaacttgtatcaatcaatcctttcaattcctcttttgcagtagtaactttcttatcccattgatctaaccaggcttgtgcttccttttcttttccaaaaatctgaccaatatctgtcagcattttcaagtagtcactctttccataagtgatttcaataactggagcaatttctttcagtgtttctaagttatcatcaccagaaaatactagaatgacatctggcttttgtgcggcaatcgcttctgtatctgctgttgttaattgtggaacatcctttagtttgtctccaaagacgggactatttttctctaaatctagactatagctagatacatcaattcctaattgtaagagatagcctgtgtaagagtaagcaaagttgacaacttttttaggattttttggaatgtcaccgtggtaagtaatgccttcaatctttggcatgctagacagttctacgtctgttgaagaggaagaggtagagcaagctgttaagaaaaccagcccaacaaataaactaaaaatagctaaaaactttttcattttttctccttattatttttttaaatcgtaagttagcaaaatagggtaatcttgaccagcaacctgcatcaattgaggttcaatgctaaaaatgtccctaagtatctcagttgtcatcatattggacacagatccatggtagcgaatatctccctctttcatggcaatcatataatctgaaaatcgagctgataaattgacatcgtgaaggaccatcacaatggttttctgtcggctttgattcagttcttttaaaagttctaagacttccaattgatgattgagatcaagataggttgttggttcatctaagaaaatggtatccgtatcttgggcaagtgccatcgcaatccaaacccgttgcctctgaccacctgataaatcatcaactggtaacctagcgtagggagcggtccgggtgacttccaaggcccagttgattttctctctatcctgatcagtgagatgtcccagcccattttgatgcggaaagcgaccataggagaccagttcataaacggaaatcccttctgtcgcttctaagacctgagggagcagggccaatttttttgcaacttctttggttggcagttgtgaaatggcttgtccatctagatagatagccccttcttgaacaggaataatccttgtcaacgccttaagcaaggtcgattttccacagccattggcaccaatgattgtcgttatacttccttttggaatacttgttgataattcatcaataataatccgattgtcgtaagagacttggatattttccgcttgaatcgaagacacaaactcctcctttccagaatatgattcattaataatttgttccgaccagtattatatcaaaaaaatttaccaaaacaaagagttttctgaaaattttaatttaatgagaatcgttataaaaaagtccttgtttgtgaacaaggaccgtatgttacaaatattgttttgctacttccaaatcaccgtcataggcggccttttcgccgtttacaatctggtaggcatcggctcccttgcctgcgatgatgacggcatctttcggagagcttgtctgactcatggctgtgcgaatggcttcttcccggtccaagataaagttgcttgtacgggtcatgtgggcacggatttgttcagcaatagcagctgggtcttcacggttggggtcatcagctgtcagaatcacctcaatctgcggatagtcattgagcagaagaccgaagtctttgcggcgactttctcccttgttaccaggagctcccaaaatcaaaaataccttgcctgtctggtgctctaagacgacatcaatcagcttcttgacactatcgccgttatgggcgtagtccacgaataccttggcaccgttttgctgggtcaggacttccatacgaccagggacattggtttgggcaatccctgtgtgaatatcttccagacttgctcccaaacggagacaggccagtcctgctgcgatggcattttcttggttgaagccaccgatcagctggatgtcgtaatggccagccaatttgccagtcgctgtaaaatcaaaacctgctgactgactaatctggttttcagaagtcggcccataaaagtcatggtctttggagctgacttgctctttcacgacttcaaaatggtccattccagcattgacaatgaccgctctgctattgtccatcaaaaggcgcttgtgatagaaatagtcctcaaaggtcggatgctcaatggggccgatgtggtcggggctgatgttgaggaagacaccgacgtcaaaggtcagcccgtaaacccgcttgaccaagtaagcctggctggacacctccataatcaagtgggtcatgccgttcttgaccgcctccgccatcatggcaaagaggtccagactttcgggcgtggtcagggtggacttgaagaaggtcttaccgtccagcgtggtgttcatggtcgaaagcatggcaggtttcttgctctgtttaaggatgttaaaagcaaaataagccgccgttgttttacccttggtgccggtgaaggccaggagtttgagctgtttctggggatgaccatgaaattccatggcaatcaggctcatagcctgcttgatgtcgtggacgatgatagcaggaatgccgacctcatagttgatttcagacacgtaaaaagccagtccggcctcgatagctttttccagaaattcctttttaaaggccaaacccttggcaaaaaagagggtcattgggctaacagtccggctgtcatagctgagagcgtcaaactggacatccgtccatgtgctgtcagtttggtcattctgtttgatatggcggaagttagcatccgccttcaatatttctaatacacgttcaattgtaatcatgcttctattgtaaacctatcgaggatatttgacaagtctgggatatgtaaatagtgggtattttgaccgtaaatttgaatgaatatgacatttcgccctgaagcaaatttgtgctataataggagggattgaaaaaggagaagtttatgttttattcttatctacgaacactattaacattcttgttgtgggccatcaatggcaatattcactatcatgatagagagaagattttgccacaggaggaaaattatattcttatcgctccgcacaaaaccttctgggatccagtctttcttgggtacgcagctgctcccaagcagttcatctttatggctaaaaaagaactcttcaaagaccgcggttttggttggtggatttcaaaatgtggagcctttccaattgaccgtgacaatcctggcatggcagccatcaagtatccagttaacatgttgaaaaaaagtgaccgttcgctggtcatgtttccttctggaagtcgtcattcatctgagctaaaaggtggtgtggcggtcatcgccaagtcagccaaggtcaaactcatgccagctacctatgtgggtcccatgactatcaaggggctcttagctggtgagcgaatcgatgtggcttttggaaatcctatcgatgtttcggacatcaagcgtatggatgatgcaggtacagcagaagtaactagccgaattgaggctgagttcaaacgcttagatgaccatgcggcatctttccaaaccaagaaaaaaccaaatatcttgacttatatctatcgtatcccagttcttttgctggttgctcttatcttgggattgacctatgcctttagctatattgccagcttcttctggcaaccaagtactcagttggataaaaataagtaaatgaaactcgcagcttgcgggttttttgtattttttacgaactatataggtggaggtaatttatggatacgattaaaacttatatagaaatgcttaaagaatacaagtggcaaattgctctgccagcagtggctggcttgctaatggcgacgtttttaatattcagccaacctgctaagtctgatcaaacaggactgacagattttcctcaaaccgagcaagcttctagcagtcaggagcagacggaggaaaccagtacagaagagagtgaggagctcagccagctaaccgttgatgtcaaaggagcggtggaaaagcctgggttatatactttagaagctggtgcgcgtgtcaatgacgcagttgaagcagctggcggcttgaccagtcaggcagaccccaagtctatcaatctggctcagaagctcagcgatgaggcggtggtctatgtagccagcaaggacgaaaacatctcggtggtggccagcacgactgccagctctgctatgtctccagaagaaaaaagcaccagtctggtcaatctgaatacggcgactgaggcggacttgcagaccatttcgggtatcggtgccaagcgggcggcggacattatcgcctatcgtgaggcaaacggtggcttcaagtcggtgaacgacctcaacaatgtttcgggcattggcgacaagaccatggaaagcattcggccttatgtcacggttgagtaagctcccctgccagcccgttcacctggcagtcttggcggtggcagcttactttgcagtccactctttttccctcttgacaatgtgcctgctcagcttggtgttagctgtctttggtgttcggcaaggtaagacagttttcctcaaaacgctgccgcttctaaccctgtgtggtctctttttcggatgccaaaaggtccaatgggagcgggcagctcagtcagccccagagcaagtgacgactgtgcaggtcattccagataccatagacatcaatggcgacagcttgtcttttcgtggtcgggctgatggacaaaactatcaggttttctacaaattaaccagtcaggaggagcagacctattttcaaaatctggcagacctggtccagctagaagtggaagcagaggtcagcctgccagctggtcagcggaatttcaagggctttgactatcaggcctatctgaaaacacagggcatctatcggactgtcaagctaacggcgattaagaagattgtccctgtccagtcttggaatgtttttgactggctgtcaacttggcggaggcaggccttggtctatgtcaaaaccaattttccggctcccatgagtcactacatgacagggcttttgtttggggagctggatagtgattttgaccagatgagtgacctctattccagtctaggaatcattcatctctttgccctgtctggtatgcaggtgggctttttcatcgacaagtttcgttggattttgttgcgtctgggcttgaccaaggaaacagtggataagttacaaattcccttttcccttgtctatgctggtttgacaggcttttctgtgtcggtggtgcggtccttggtccaaaaaattctgggtaatctaggcttgcggaagttggataattttgcggtgacggtctttatctgtctgttgatactgccccgatttttactgacagcaggaggagtgctgacttttacttatgctttcttgctgacggtctttgattttgaggatttggggcaggtcaaaaaggctgcggtggagagcctcagtatttcactgggaattttgccggtgcttatgacctatttctatgcctttcagcctctatctatcctcttgacctttgtcttttcctttgtctttgatgtcctactcttgccaggtttgtcagtcatttttctcctgtcgccagttgtcaagatgacttgggtcaacggatttttcgtctttatggagaaaatcattgtctgggtggctgatttgggattgcggccttggatactgggcaagccgtctgagctggtcctcttgcttttgctggtcagcctcttcttgctctacgatttccacaggagaaagaaatggcttctaggactgagcttggtcctcgctctgctatttttcatcaccaaacacccgctggaaaatgaggtgacggtgctggacatcgggcagggggacagcatctttttgcgggatatgcgggggcggacggttctgattgatgtaggcggacgagtcgatttcgcggccaaggaagcgtggcaggagcggtctcggcaggcaaatgcagagcggactttgattccctatctgcatagtcggggtgtggataggattgatagtttagtcctgacccacaccgacacagaccatgtgggggatgtgctggaagtggcgaagcaggtccagattggtcggattgtcgtgtcgccgggaagtctgacggtgcctgactttgtagcgaccttgaaaaaaatcaatgttcctgtccatgtggtaaaagtgggcgaccgcctaccaatttttgactcctatctggaggtcctctatccagacgggacaggcgacggtggcaataatgactccattgtcctttacggtcgcttgttggaaactaactttctctttacaggagacctggagcaaggggagttggacttgatagaaacctatcccaacctgcctgtcgatgtcctcaaagccggtcaccatggctccaaaggctcttcttatcctgaatttttagaccatatcggtgccaagattgccttggtatctgctggagaaaacaaccgctacaagcatcctcaccaagaaaccttggaacgatttgacagccggaatatccaagtctatcgcacagaccagcaaggagccattcgcttccgaggttggaaggagtggaagattgagacggtgaggaggtaaaatgataaatcctatgcacttatggttctatagtttcaaagtttatgtgctcgctgccttatctggctatattctgcactatgttactacgccagcttctgttaacgacttcaaagaggttgctgccttattggaaagatgctaacaatctgtgattgtagcagatttgggctatctcagtcagcagtcttgctcattccattgtatttcaaatagtctatattttgaatttaagaattgattttcatttcttttcattaaatattgaaatcgttttcgaatttgtggtataataaagtatgatttaccaaaggaggaagtcctatgtctgttaaagattttatgacccgtaaagttgtttatatttcaccagatacaaccgttgcacacgctgcagatattatgcgtgaacaggatttgcaccgtctacctgttattgaaaatgataagttggttggtttggtcactgagggaacgatcgcagaagctagtccatcgaaggcaactagcctatctatttacgagatgaactaccttttgaataagactaaggtcaaggatgtgatgattaagaatgttatcacagtctcaggttatgctagtcttgaagatgctgcttatctcatgtataaaaacaaagtggggattcttccagttgttgacaacggtcaactatatggggtcattactgatcgtgatatttttgcagcttttcttcatgtctcaggttatggagaagaaggagtacgcgctcggttccttgttgaaaataaggcaggggagttagaaaaaattattcgattggtggcagataaggattataatattgtatctactgtgcaacttgctaccaagtccggaaaagttgtcatcgaagtgcagattgacggaaaagttgatgttgaagaagttcgaactcttttcgaaggtgcaggtatccaagtggatagcttggttccgactgttgctaaaaatatttaaaaaccgagatttctcggtttttttctttagctatcattctagtattttaggggaatgtgatataataaagtatatcatgtgtgaggaggctctatggggcacaaatataaaaagtataagaaatatggtaaaaataattcaggacttgtggccctccttgttttattggcaatcggttttgtcatgagtttctggtatatcttattgcccactgggctcttaattggctatttttacaagagagaggctatccagcgttttttgaatagagattctataaaacgcttgcaagtattagcgctatctattcgttcgggctatgaaaagcatcaagagctcttggtggaaaagggtgaggataaggttgtattacagttgagaaacagactgttaggacaattatttgaattagatcagctctatcaaaaatttggaaaatatctgaatggatatgaaagtaaagaagttgtagataccttgcaactaaaatatcatttaaaactgccagaagctaaaacagaaaaaaatactgacacacaggtttctactggtggtaatgctgtgatggatgaacaaggcatgatagcggatttagctcctgaaattctagaaacctattgtaatattcaaagagacaatcttgttattcttgaaaagctggaaaaggcgacagataagcgggaagaattgacagctatccatgaggccaatatgaatcggtttaacgatattttacagggttatttgaaaatcaaaaaatcaccgaaagattattttaacgcagaagaacgattggtgcaggcaaaatcagccatggaaatgtttgataaggatttggatgataccatcaaacaatttaacgaagcggatatgaaagattttgaagtcagtctgcgtatgatgaaaagagaagaggaatagagaagatgtcaggatttaatttcgatattgatcagattgctaataatagtttatcaaccaaagataagacaacagagcttattcaagcgactccgactggagataattcaaaagtgtctttcttggcacagttgacaccggaacaacaaacaggtattcgtgccaaggctccccaattggtggataatttcttagctaatcaaaatgtcctcttggattttggtaaggaagcggtagaagaagtcaatgccacggtcaatcacattttgtcagaacagaagaagattgaaattccacaggtcgatgagcttttggccaataccaaccgtgaattgaatggttttgtggctaagtataaggacatttccacaactgctgaattagaaaagaaacctggtttcttccaacacctgttcaagcagaccaaaaatgatttgcaggaattttatttcgattcgcagaccattgaaaagaaaatggatagcatggcagccagtgtggtcaagcaggaagaggtgttggcgcgcaatattgtttctgcagagcttttgattgaaaataataccaagtctatcgagaatttggtgggggtcatcgcctttattgaagcgactggtcaagaggctgcccagcgagcaaaagcagagcaagaacgcttggcaggtctgcaaccaactacggtagattatcaagtagcttctgagaagttggcacgtgtaacagaggttgctaatatcctcgaacaacaacattctgagtatatgagtcgcttgtatgtcgcgtggacaacgacaccgcagatgcgtaatctggtcaaggtttcttcggatatgaaacagcgccttgggatgttacgtcgcaatactattccaacaatgaaattgtccattgcacagttgggcatcttacaacaatctatcaagtctagccagacggcagatgcgattgtcaatgctaataatgctgcccttcaaatgcttgcggatacatcaaaagaagccatcccgatgatggaacgcacagctcagaatccgaccctttcagtagcatctgttaccaaattggcagaaagtttggttgcccaaaataatggcattattgcagctatagatgaagggcgtcagaaacgtcgtgagttggaggcagctattgtacggtcagcagagactatcaacgattctgttaagctacgcgatcaaaaaatcattgctgctttgctggagcaaggcaaagaagcacagtctgaggcagagcaaccacttgaaaccaatcaataatataaaacctgcagttcagcgaaactgcaggtttgtttaatggcgttctattggttttttatctcgatctaaagtaaatccctcaccgagtacttcatgtgcgtctgtaatggtgataaatgcgtgggggtcaatacgatgaataagctccttcatctcttggagttggctcttatatatgaccgagtaaatcatgttgacatcggctttgctgtagaaaccttgtgctttgataaaggtgacaccacgctcgatttcacaatcaatagcctgagccaattggtcagatttttgagaaacaatcataacacccttgctaccatatccgccctccgtgacaaaatcaataaccttggaagcaatagcaaccatcattaaagtatagagaactgttcggaggtctttaaaaacaataacaatcagagttaggatgaggatgtcaactgcaagaatgatttgtccaatggagtaaggtaggaatttatgacctatacgagcaataatatcgcttcccccagtcgttccgccagcacggaagatggttcctaatcctagtcccataagaatcccacccaggatactaacgagtatcaaatcttgttgtagattgattgaaaaatggattttttcaaaaatggccaaccaaaaggtaacgctaaaggttcctaagatactgagatagagagtcttctttccgagtattttccacccgaggatgaacaatggaatattaatcacaatgttcattatccaaggttgaatatgaaaaaggtagtaaataatcagcgtcaatccagttgcgccaccctcgaatagacgattgggcatgattaaataatttagcccaaaggcaaatagccctgcaccaagcaaaataagtaaaatatttttcaaacgaaccataagcatctccgaatatgtgtatatatcaattttaaaagattttctccttaaaaacaagtcaattttcaagtgattttttgactaatttttggtaaaatggaatgaatatctaagaaccagtcttcacaagtgaagtgctgaactgtgcatactggtactaagagcgagggaaagatgagaaacggtttttttattacatttgaaggtccggatggggcagggaaaacaacggtattgcaacagttattgccagccttgcaggaattggggccagaagtagtcacaactagagagccaggtggggtggctattgcagaagaaattcgtaatattattctgaatcctgcaaatacagcgatggatgataagacggagctgttattgtttattgcagcacgacgtcagcatttgaaagagaagattcttccacccttggcacaggggaagttgctcttgattgatcgttttatcgattcctctattgcctatcaaggatttggacgggggttggatataggtgacattcattggctcaaccagtttgcaacagatggtttaaagccagatttaactctctattttgatattgatacagaagaggggctggctcgaattgcccgcaatgctgaccgtgatgtggatcgcttggatatggaaaaagcagatatgcatagacgggtgcgtcaaggctatcttagtattttagagcaggaaccagagcggtttgtaaagattgatgccagccagccactagaggctgttgttgcaaatgctctggcggtcattaagaaacggtttgcagaaagaacatgaagattgaagaacttagaaacttacaaccctatgtatttcaacgttttgtgacaattttagagcagagacgtttggcacatgcctatttattttcaggtgactttgctagttttgatatagcaatttttctcagtcaatcgttattttgtcaggagaaagaaggcatccttccttgtcagaagtgtcggtcttgtcgtctaattgaagcaaatgagttttcagatcttactgttattgcaccgcagggaaatgttatcaaaacagatacgatacgtgaattagttaagaatttttcacaatctggatttgaatccaataagcaggttttcattattcgtgatgctgagaaaatgcatgctaacgcagccaactctttgctaaaagtgattgaagaacctcagtcagccattcacatcttcttattgaccaatcaggaagaagctgtccttcctactatcaagagtcggacacagattataggttttcctaaaaatattccagctatggagcgaatgttagaagaggagggcttgttaaaaacacaagcgaatctcttagctcaactggtttcaagtcaagaagaagcgaaaaagttagcagaaaataaaaactttttagatttgatgggacaggcaaagaaatttacagacttgctcttggtggagcctacacgtgcttatttgcaagttggaatcctagtgtctttagctgtggaaaaagctgagcagggacgtttgtttgaccttctgagtctgatattatctgagaaaatgatggaatcggcaaacgtacgtgaaaaaatggatgctgttcttaaggctaagaagatgtggcaggcaaacgtaagtctacaaaatagtctagagtatataactctgtaaaataaaagaaagggagataatggataaaaaagaaatttttgatgccctagatgatttttcgcagaatcttctaaccacgttggcagaagtggatgctatcaaaaagcatttacagggagttattgatgaaaatacgaccctccgcttggaaaattccaagttgcgcgaacgtttggaaaaagaagataagacaggccataaatcttccaactttggtaaggagaatttggagaatatttacgaagatggtttccatatttgtaccttctcttatggtcaacgtagggataatgatgaaccttgtatgttctgtgtagaattattgaatcgagattaggatgaaagtacaaaaatcatttaagggacagacgagttttgggactttatatctggtgccaacgcctattggaaacttacaggatatgacatttcgagctgttcagattttgaaagaagtggatataattgcagcggaagatacgagaaatacaggcctcctactcaaacattttgaagtagaaaccaagcaaatatcctttcatgaacacaatgcccatgaaaaaattccagttttgattgattggctcaaatctggtcagtccattgcgcaagtttctgatgcaggcctgccttccatttcggatcctggtcatgacctggtaggggcagcgattgcggaggatattcctgttgtagcacttccaggagcatcggcgggaattacagccttgattgcatctggtttggcaccccagccacatattttttatggatttttaccgagaaaatcggggcagcaaaaagaattttttcaagaaaaaaagacctatcctgagacgcaaattttctatgaatctccatatcgtgtggcagataccttagaaaatatgttgacagtttatggtgatcgtcaggtaacggttgttcgagaattgaccaagttatacgaagaataccagagagggagcatttccgaattactagagtatttggaagaaaatccacttaagggagaatgcttgattattgtcgagggtgctggtgaagaagtctatccttctgctgatgaagtggacttgaaggctgaggtagaaagggaaattgcaagtggcataaaacctaatcaggctatcaaagaagtggccaaacgctaccaactcaaaaaacaagaagtatacgatatatatcatggactaggttaagacctagtttttttgtatgtttatgcaagcttatactcttcggaaatcaaaattatccgttgtcaagagccttgatgagtgaaaagctccagtggatcttttcagcctgttaccttgaaatgagaaagtaacagagttctatcttcggcttaatgacgcgaacacagttctctatacttccagccttcaactatatcccagctaagctacttttgattttcattgagtattaatatgcagatagcaattggtgacactccccaaacagtcaaatctggtcataaaattttcattgaaacctgataaatccctgtgaggcaagcgcctcgtttatggctaaaagtaagaggtgctttagaaagtagaataaatataagaaatccgaatatttttacaaaataatcatatttcatggaattgtctgaatatttgtgatataatgaacagactaacttaatggagggattttatgacaatctacaacttctctgcaggtcctgcagtattgccaaaaccagtacttgaacgcgcccaagctgaattcttggactacaatggttcgggaatgagcgttttggagatgtcgcatcgctccaaggacttcgatgatattattaaaggtgctgaggcaacgcttcgtgaattgatggccattccagataattacaaggttattttcttgcaaggtggagcttctttggaattcacaatgattccccttaacttcgctcaaggcaagaaagcctactatcttgtaggtggctcatggggtaaaaaagcctatactgaggctgtgaagctgtctaaaacaattgcctttgaaccaattttgcttggatcaacggaagatattacctatgcagaattgccaaccttcgataaaaatgatattgatccaactgctgcttacgtgcatttgacaacaaataacactattgaaggaacagcagtttatgatattcctgacaccaatggtgtgccagtcattgctgatatgtcttcaaacatcttagcggctcgctataatgttgaagattttgccatgatttatgctggtgctcagaaaaatattggtcctgctggtgtgacggtggtgattgttcgtgaggacttcctcaatgatcaaccaatgctttcaagcatgttggactaccgtattcaagcagaaaatgactctctttataatacgccaccagcttattctatctatatttctaaactcgtctttgaatgggtaaaagaaattggtggtgttgatgagatggagaaaatcaaccgtgaaaaatctgggttgctttatgactatatcgaccagtctaatttctatacaaaccctgttcgtaaaaaagaagagcgttcagtagcgaacattccttttgtctcaccaagtgaagaattagatgctaaatttgtcaaagaagcaacagcagctggttttaaaaacatcaaaggtcaccgttcagtaggtgggatgcgggcgtcgctctataatgctttcccacgtcaaggtgtggttgaattgattgaattcatgaaaaaatttgcagtggagaatgcttaatggaaattagattagcacatccaaatgagatggaggctattgtcaatattcttgaagatgctcgtgcatttctagcaacctccggtatcaatcaatggcagggagagtatcctaataaagagaatatttttgatgacattctttctggcagaggttacgttggtctagttgacggtaaggtggcagcttatgccgccgttcatcgtggtcaagaagcagaatatgaggccatatatgaaggaaaatggcagcacaatcatcctgtatatacaacatttcatagaattgcagcagctgacgaatttcgtggtcaaggaatcatacaaacttttttgcaaggtttaattgaaggtcaaaaaggaccggatttccgctgtgatacccacgagcagaataagacaatacagcacattctaaaaaaattgggctatgtctattgtggtaaagtcccaatagatggagaacgtctagcctatcaaaaaatcaagcaaaagagcgagcggagtctttaccaggaaatcagtgaagacgaccgttggttactcggaaataattaatgaaataaagaaagaaaaggcggcagctattccgcctttttaggtaaaaataaatggtatttagcgtacgtacttttaacaatatcaatcaaattggtcttaaggaattaggcaataaattccagattgacggagatcatgcagcaaatccagatgcctttattattcgatctgaaaatttgcatggatttgattttcctgaaaatctaaaagctattgcccgtgctggtgcagggactaacaatattccaatcgaagaggcaacagagaaaggtattgttgtctttaacactccaggtgccaatgccaatgccgtaaaagaggcagtcattgcttccatcctcttgtcagcacgtgactatatcggagcgactgcatgggcaaatacattgtcaggagatgatgtacctaagcaggttgaagcaggtaaaaagcagtttgctgggacagaaatttcaggtaagactcttggtgttatcggacttggtgctatcggtgcgcgtattgccaacgatgcccgccgtttgggaatgaatgttctcggttacgacccttatgtatcagtagaaactgcatggaccatttcaagccatgtcaaacgcgtggatgacttgaaagaaatctttaccaatgcggactacattactgttcatgttcctttgacagataagacacgaggacttttcaatgcggatagcttttgtcaaatgagaaaaggaacaaccttgataaactttgcacgcggtgaattggttaataatgctgatttgtttgaagcaattgaggcaggagttatcaagaactatatcacggattttgggacagaagaagtgctcaacaaggacaacattatcgtcttcccgcacgttggtgggtcaacagaggaagcagagctcaactgtgccattgctgcaggtcagaccattcgtcgttttatggagacgggtgaaattatcaactcagttaacttcccaaatgtgaaacaattcctagatgcaccgtatcgtattaccttgattaataagaatattcctaatatggtggcaacgatcacaacggctgtatctgagttgggaatcaatatcgataatatcatcaataagtctaaaggtgactatgcctatactttacttgatttggatgaagcggataaagtgaaaattgagcagttggttgctaaatttgaagcaacggatgcaattgtcaaagtgcgtgtcattcagaataaaaactaatcatgctgtataaacaagtctatcacagtccacttggccccatgtcattaattgctagtgataagggattaagaggggcctggtttgagggacaaaaatattttgaacgaggcttgaatgagaaagctattttagcctcccatcccattttagaccagacagctcgattgcttgaccagtatttttcaggggatcaggtggacttttcaaaccttccattagaagctgtgggaacaaatttccaagagcatgtctggcaattattgaagattattccgatgggtcagacgactacctatggacaactggctcagcaactgggccttcgttctggtcaggcagtaggaggagcagttgggcgtaatccttattctattattgttccttgtcaccgagttctcaatcagaaaggacagttgacaggttatgcaggtggactggataagaaaatctggctcttgcgacatgagaatccagaatttgaggtgaaagatgattttattttatgagtatccaaaatgttcgacttgccgagcagcaaaggcggagctgaagagtttgggattggaatttgaagctattgacattaagtcaacaccgcctagtgctgaagagctaaaagcttggatggaggcgacgggactagaattgaaaaagtattttaatacttctgggaatagctatcgtgaattaggcttgaaagataagtttgatagtcttagcttggagcaggcacttaatcttctagctaatgatggtatgctgattaagcgtcccctactgattcaggatggtaaaatcttacagattggctatcgaacaaaatacgaaaatctcggtttataagccgagattttgtttattatagtgcatattctattgaaatatattcatgatgttttttcaaaagatagagcatctgaggcttatcttctaagagtttttggataatttcgtgatggacattgtggagattgattttaacgcgaatcttcatgccttgtttgaaaatatggatttcgacatcattgctatcttcctttaagtaaggctccaatagctgatagatagaatcatgtatctcagggaaatggatcgttccgttggcgagttccttgaaagatgccactaataagttccaaggttccttaaatgaaatgattgctagtgctagtgtcaaaaagaagtcgccagtataatgcaggaagccgaaccaagagttgataggaacaagatagagcagaagaattgcaattccaattgcacctgaaatgagtccgtctacaaggttgccttttgcttctgctaatatgatagtagacagatgattgactttggcactcatatggcggttgtataggtaaagccccatacagacaaaaaacatggttatggtataagggagaacgggacctgtagtcatttgatgaccgattccatgaacaaagtaagcaaaggctgtcgcgcttgtttcaagtacagcaaatacaaggagtagtagagttgcgagagatttcatgatagcgtagagaggttctagaaagtatagtccttgaggaaaagtctcggttttccgatggctatttttcgatatgtaaactgcaactaaggacgaaataaatgctattagagaaaagactccgtctaggaggagggcgtttaggtcagtcatgatataaacggcaatacctgctagtccagataaaccgttcacaacagaggaaacagttagagatttgcgttcgataattttgtggtccataatccctccttttaatatatatctatatatttattttaccacaaaatgacaccgttttcaaattgagcggattaaaacaaggtagagtgataagaaataaaggctcaaaacccttgcaatagatctacgggttttaagcctttaatatctgttatctgataattgaaatcaggttaatttccactgttagaatgaaatctccatcacaattggtgtatggtcctgacgagcaccggagtcaatcatatctgacttacttactttgtcggcgatgcggtcgctgacaagccagtaatcaattctccagcctgtattgttgattttactggtgcggctacgttgtgcccaccaagtataggcgttgagaacatcaccgtgcaagtggcggaaggtatcagtaaaacctttagctagaagatttgtaaaaccttgacgttcttcatctgtaaatcctggagattgacggttacttgcgggattagcaaggtcaatttccttgtgagcaacgttgtagtcacctgttgcaagaacaggtttgtggctatcaagttttgctaagtagtcagcatactgtacatcccagatttgacggtcagcaagccgtttcaagccatcaccagcatttggcgtataaacttgtgtgacatagaagtcatcaaattctagcgtgatgatacgcccttcagaatccatggttgttggagcaccaatctcaggaaaggttatggttggagttagatggtttttgtagaggaagagtgtaccagcatagcctttgcgagctggttctacagatgaacgccaggtattggcatatccagggaagtagctttccaaaatttctagatgctttttagtcggtcccttatctgacaattttgtctcttgaatggcgataatatcagcgtcttctgtcacaagtgtatcgatgactgcgcgtgataatagggcgcgaggagactctgcagtcaatgcagcgttaagagaatcaatgttccaagaaatgagtttcataattttccttttctagtctgttactgttttacattataccaaaaataaaagttgcaggcgaatatggaaacttgaaaaaaattttataattcttgtattataacattaaaattgtgatacaatagaactaataaatctgtgtcaaggaggttattatgaaaagaaaattatttgtttttgcctggttagccctagttttggaaatgctaatctactactggtaccagttgcctgctttaaatattttgagtgtggacttctggatatttttccttcaatctgtcggattggtctggctcatactttccacgttcagctccaaaggtgcttttcaaaaggtgaccaagatttccggtcgccagagacaagtagatacctatcagattaaaacctcgcaactaccagcttacttaaaatggttgggacgaatttgggtattggttgtcctgggtttgttggggttggggcttatcaactcacgtgtatttcgtgctaaggattacgctgctgtcataagcgtcaaggatgcggattttaaagcagattttcctgaaacagacatatccaaattggccctcctagatcgcgcctcagccgaaaaaatcggtgatacttatctaggtaccattgacaaggtctcccagtttggcatttcggatgattatcgccagattactatcggtcagcaaccgttccgtgtatcgcctttggaatataagaatttttggaaatggctgagcaaccatcaagatgggattggttactacgtgaaggttaatcagacaacagggaaggcagaacttgccaagttgagcaaagccatgcactattcagattccgaatttttgctgaatgataccttacgtcatcttcgcctgcaatacccgacaactatttttgggaaaccatccttcgaagtggatgaccaaggaaatccatattatattgcaacgatttacgagccaaaatttggactttcatcaaatgatccgattggtgctattgtattggatgcagtaacaggcgaaagtaagaagtatggtctggaagatattccagagtgggtagaccgtgtttattcggcaaacaatgttatcagccgtgtagatgaccactatacttatcaaaatggtttctggaataccattttcagtcaaactggtgtgaaaaatacaacagacagctataattatatttctatcggctcagatatttatctctacacaggtatcacctcagcaactgctgattcatccaaccttggatttattcttgtcaatatgagaactcgtgaaattaccaactacaaattggcttcggcgactgaaacagcagcgcagaagtctgcagaaggtgaagtgcaggaaaaaggctataaagccactaatccaagcctagttaagttggcagatacagcctactatttagtatccttgaaagatgatgccggcttggttaaatcatacgctcttgttgatgccgaagattatcaacaggttactgttaacaacgatattgcgctcttaatttctcaagtcacaggaacggatgcttctagcctttcaggattgacggtgactgaaaatggagaagttggtgaacagactgaggttatcagtggaaaagtagaagctttagcgagtcaaataattggcggtgcgacaatctactatattgagtctgagggcaagatttacaaagtcaaagcaacggaagatagtacagatcgattaccatttatcaaagtaggagatcactttagcggtcagttagataagaaaaattatcttaaaaactttaaggttaatccagaataatcataagaaagagtgaggtagaaaagccttgctcttttgcttgtcgtcacccatgcgaaatatttcaacttatggtataatggagtgttgtggttctttgacaggaatccgtagattattctgtcgagtatccatattcttattctgaaggagtattttgtgagtttatttagaaaaaaacaagcagtcggtcgccatagtcaaatgcgtcggcatttaggcttagttgatttgatatttttaggtatcggttcgatggttggaacaggtatctttacggtaactggtttggcagcagcccagtatgcagggccagctctgatcatctcaattgttattgcagcaatttcagtcggactaacagccttgttttacgcagaatttgcctcgcgtataccgactaacggtggtgcctatggttatctctactcggtttttggtgaatttcctgcctggattgctggctggctgacaatcatggaattcttgactgctgtatcgagtgttgcatctggttggggagcttatttgaaaggactcctggctaattttggtatcgctatgccgacagctctgaatggaacttttaaccccgctgcaggtacctatgtagacctcttaccagttctcgtcttgatttttgtggtaggagtggtcttgcttaattctaaggcagctcttcgtttcaattcagccttggtagttttgaaattttcagcgttggctttatttattttagtagggttattctttatcaaaccagaaaactggtcgaacttctctccttttggttttggtgccatttatggtggacaagcaggaattatggcaggagcgtctctcatgttctttgccttcctgggatttgagtctatttcattagcaattgatgaggtgaaaaaacctgagaagaatgtaccaaagggaatcgtgttgtctctatccattgtaacaattctttatattgtagtgacattagtattgactggtatggttcactatactaagttgaatgtggcagatgcggtagcttttgcacttcgagaagttggattggattgggcagcgagttatatttctattgtagcaatactaacattgattacagtatgtatttcgatgacctacgccttgtcgagaatggtctattccatcagtcgtgatggtttgctaccgaaatcattgagccgattgacacaaacaagcaaggttcctaagaatgcgaccattcttgtggggatttttgcagccatttgtgcaggtatttttccactagcaagtattgcttccttcctcaatatctgtaccttagcttatttgatcatgctggcgttgggtattattcgtctgcgtcaagtcgaaggtttgccaaaagatggacaatttaaaacacctcttgttcccttgttacctatcctctcgattatcatttgtctttcatttatgttccagtatagtttagatacttggttagcattcggagtatccttggttattggaattttgatttacttctgttatggctatcgtcattcggaagcaaaataatagatttcccttcttttatttgaagggattttttgtacaatttttttatagaaataatggaaaacttaaaaataaaatagtataatatatataaatgatacaaatatatcaaaggagaaaagcaatgtctaatagcgatattcgagctaaagcaacggttattcgtgaacaaacagataggatgataaccttgtttttggcacctgttttgatttcttttctgtcaggagtggcagaatttggcttgaaacaaatctgggggcaaactggtactttctcctggggcacaactattgtgaaagacggtgttacttggactcatcattttatttctgttggcccgtcaatcatatttgattttattgcacaatgtttaattgtaacagcttgttttcaactaataagactggtgagaaagcaaagaaccaaggttagctttacggagtgtttcactttactagatggggagaattttttaccagtttttagtacgacattattgaaaatgctggtcttgtatttagcaagtttccctgctgtttttggaatgatattgataggtttagctttctatagtactattgtcatctttggtgctcctattgattatcagcctgatttttcagcttttttcagttcgtcttattttcaaacaggattaatactggtatgtgtagggattatttgtagtttattcgtaggatatgggctcagtcaggtcacttttcttctctatgattatttggaaaacaatacctattcttcaccatttaaactcttcagttagagctggcagttgatgaaggggaataaatggcgccgtttcctcttggatttatcttttgttggctggtttattggagttcttttgacgtttgggtttttgggactttacgtatatccatactattggacttgtcagactatattttatgaagatttgaaggccaagaatccattggtgttttcaacatataaatcagttatctcttccatagtagcctagggagtatggagataacaaattattaggaatcccttcgtattttggagggattttcctgtttttaagagatgttctggaaaattaatggataaagttttatactaatagtaggatggtaaagtagtccgatgtagatataatatttgcgacgtgactttataaataaggagagaaaattggaggggaattgtgatgatgacgagtgatatagtatcaagagcgatgatgactcgcgagcggacaagaggtacaacactactattttttccctccattttgctatctattgtttatgctataccagcaacaatttttcgcctactaacatttctagagctccgtcaaaacagtgcttttgtggaggggcgattggtatcttcaatcaggttgacctatttaggtgagttaggcttcgctctgttgttacagctgttcatcggtctgtcctgttttcatttattggaattgttgagaggggatagacaggagttttctttaaaagatagtttttcatttttaaagacagaatggaagaagcctatctgtaccacttttctttattattatttgcttctttttatagctggacttccagctaatctaggggctactttatttattaaaggcttcacaatgagtagtttgatggtcttatctccgggggcaatggcagagctggcagttcatcagcctagtcaattaatgaagataggggctccgattttcctgctaggaatgattatttacctttttgtctactatacctactcacaggttgttttcgtcttgtatgaccatttggataatgctagttatactggtcccctggctgtatttagggaaagtcgtttcttgatgaaagggaactattggcaacgtatttggttagatttatcctttttaggttggtttattggggaattattgacccttcatctgttatctttttttgtgactccttactatcatttatccaggactattttctacgaaaaattgaaaaaacaaagactgtcagctgtagagtagctaacagtcttttatgattatagggagcttgttttgggcttgaaatagagatcgtaaaccaaccagcaaatcattataccttggacaagcaagctgatgacggagccctctacgccaaactttccaccagatagccactcaggaccagtgataccgatttgaataaaggcctgaccagcatcggtgccgctgactgagaaagcaaaaacattcccttggaaacagttccacgcagcgtgtaagccaccaatcacccaaatgttgcctgttttgagcataatgaggcaggcaagaacggcaaatagagttaaatccaaaattggaatgagtgaaatagcattgtttccgaggtggagaaatgtgaagaagagggaagaaacaatgataccgataggaatattatgtctagcagaaagtgatgagaacatccatcctcttgttagaatttcttctgtcgtaccttggatagaccaggcaaggataaggataataaattctccgactaattttgtagagaactggatgcttgtaaattcaatcgcgcctaatccccacatgatgagtgtacaagtggtcagcattgcagctccgattccccacccgagtagaaaatcttttcctgcaccttttttagtaaaaccaagtcctacccacgggcttttttcaatataccgtgcccataaaatgaccatcaggctgataaaagcgaaagcgaacagttcaaaacttacagaaagggtctcgctaaatgggagtaaaaagcttattggagtgaaaataacagctcctagtgaatctcctactagcaacaaaataatagctacaataggagaggtgacgatgttgagattgaaagctgattgagccttctcattgataaattcggttttcataggacctccttttactagatactttactagttcactattctatcatatttttcaaaagaagactagacctaatttcctagtatatggtagaatagtacaaagctatataaggagaatagtatatggaattgagtcaatggctgaagtcctttcaactgaaagataatcgactagtgggcccattcttttatggcacacctcttgctcttagatttgaaatcgggcctgcagacgaagcagaagaattatcaagagcaatctatcttgaaagagcctatgcacgtgcagtagaactttttgagcaggctagttcagaatacgactatgtgctcctttcgctccttcgacaggaagatagggatatagacacctacctctggcatttttcatcgaaatttaacttcaacaaggtccctgagtctgagttgatagaagtggaggattggacgggagatgtgctagtctttgagcgctatctctttccagttaccgaccaggacctaaacgctttgttgagggagattgtcaaagccgaccatggaggttttaactatctatcaagttccgttctcttcctatctagtcaggacaatatcatctatcattgctacgataatcggggagttgatattgctgttttagctgatgacaaacgtttggagctctttacagactgccatgacctccttttggactatgatatggaggagatggagagaagggtgagggggtaggaaaccattactaaaggtgatataccatctcttagataaaagtacttcacaagtgaatacaggttcaaaaaaatccacagtaaaacctgtggaaaatatggtagaatagaacagtagaaaagttccaaaagtggagcggaaatctattttgggaggtggcaacttcatttttgatggaaagtaaaactttctcatcaaaaaacgaggctgggcaaaaagtccaaagccacttctcagagttcgtgtcaacatctcagcgcagtggttgtttgggtttaacagtccagtggactgttaaaggttggagataggatttgcaaagcaaatcacagcagttcgtgtttcacactccaaatctgaccattacgactgatgcgaacagagttcgcttcatctccaacctcaaactgtctcccagacagtttgagctgtgcggggggtgggagtgaaacagtctgggaatagactgtttcagctcaacaacttaaaacgaaaaattgttgacgaactctttttgacaagttgagttctttcccactccctaaaagttgcactaattcgatttttgaaaaatattgtttcaaaaatctcatgtcgatgccagagacaatcagcatctctattgattttactctaactaatgtctgtcgcagaagccttcgggctgatgtttcagtttagcacgttgctaatcgtgctactgacatttatttttaacaatcgtaaaaaataaaagacagccaaccgctacgaaactttgaccgagtgaactagcaggttgactgtaatcttcatttgtcccgtctttaaaatgttcaaacagtctgggagactgtttgaggtcgtttctcgaaaacggaagaaaacgatactgggattgagttggcgctcaatcccttttccaaaactattataccacaaaccaaaatcgtttgacaattttttatctacatcatcaaaaacggcttgacagcctaagaaaaggagaataccatgagcagagcagagcagagcagagcagagcagagcagagcagagcagagcagagcagagcagagcagagcagagcagagcagagcagagcagagcagagcagagcagagcagagcagagcagagcagagcagagcagagcagagcagagcagaagcttggagactacactcaagttgaaaagctagacctaaggtcaaaagatgttttatcagacaacattgcaaaaattggtcagctttttcctgaggttctaacagaaagtagtgatgaaaatggcaggtaaaccgaccaccaagacccttcgcccagatcttgaggaaagtgttgactttgacaagtctgaaaatgtctttataacaggggacaacctggaagtcctcaaggtcttgcaggagtcttatctgggcaagattgatatgatttacattgacccaccttacaatacaggaaaggactttgtctattcggataaattccagatgagcgaggaagaactggcagatgaaatggatctgcgtgatgaggacggtttgcaacgggtgggcttgaccaagaatgaaaaatcctccgcccgctatcattccgactggctcaatatgatgtactctcgcctagtccttgcccgcaacctcctcaaagatagtggagttatctttaatctccattgacgataacgaacaagccaacctcaaagctatctgtgatgagatatttggggaggagaattttgttgctgatgtcatctgggagagagcatttgcacctgtaaacttgaaaaaacatttttcagaaagtcatgattatattttagtatatgcaaaaaatgtagaatttgctgtcaatcatggaatacctagaagcgaagactcaaatagtagataccaaaatcctgataatgatgttagaggaccttggacaagtggtgatttatcagtaggaccagcagttccttcaaatatttatgagataatttctccaagcggaagatctatttttcctccaagcgggagaagttggttgctgagtaaagaaagatttgaagaatttattgctgataatcgtatttggttcggggctaatggagataatgtgcctaggataaaaagatttttatcagaagtaaaaaatacagtaactccaatgacgatttggaagtacgctgatgtcggtcattctcagtctgctagccaagacttgaaaaaattatttgatggtaaggcatatttcacctatccaaaaccagttccgttgatgaagcaaattgttcaattgtattcagaaaaagacggcctgatcctcgacttcttcgctggttctgcaaccactgctgatgctgttatgcagttgaatgcagaagatggcggtaatcgtaagtacatactctgtacgctggacgagcaggtggcagacaagtccgctgccaaggaggctggctatgaaaccattgaccagatttctcgtgagcggatccgtcgggctgctaaaaagattcaagaagaacacccagaaacagtcggcaagcaagattttggcttcagggcttataagctagacacttcaaacttcaaggatgttagccaaacaccaaacagctttagccaagaaagcctatttgacagtgtttccaacatcaaagacggtcggacagaccttgacctgctcttccagattatgctgacatggggcatggaattatctcttccgattacgaaaacccagattgacggtacagccatttataatgtagcagatggtgccttgattgcctgctttgcggatgagatttcagaaagcgtcctctgtcaaatcgccaaagcagagccccttcgtgctgtttttaaggacgaatcctttgccaactccgcagccaaaatcaacctgggccaaatcttcaaagaagaagcaccaaataccaaagtgaaggtggtgtaggagatgaaacttcaatttaagcagcagcaatttcagttagatgcggtggcctctgttgtggatgtttttgttggtcagggcaaacatagcggttttgattaccacatggataaaggtcagggaatgggtgcggaactggacatgaattttatcggtttccgcaatgctcccattcagctttcgcaggaaactgtcagccagcaggttcgagctaagcagctcagctatggccttaaaccatctgaaaacttgtctattcaaaaagtggatggtcgtccgtcttacaatttgactattgagatggagacggggacagggaagacctacacctatatccgtaccttgatggagctcaataagcagtatggttggctcaagtttatcatcgtggtgccgagcattgctattcgtgagggagtgctcaagtcctttgaaatcatggcggaccatttccagatggagtatggcaagaagccacgctattttgtctatgattctagccgtttgggcgagctggacaagtttgccaactcctcggacattcaggttatgattatcaactcacaagcctttaatgccactggagcagatgcccgtcgtattcacaccgagcaggaaagtttccgctggagaaagccgattgatgtcattgcggcgaccaatcctattttgattatcgatgagcctcagtcggttgaggggaaaaagactaaagaacgcttggaggacttcaagcccctatttactctccgctattcagccactcataaggacaagcacgatatgatttatcgtctggatgccctggacgcctacaataaaaagttggtcaagaagattgccgttaagaccgtggagcagactgcaaccacaggaacacaaggctacctttatctgcaagaactggttccgcaaaaatcaggttctcctaaggctcggattgagtttgaagtgcggaccaagtcaggcgatgtcaaatgggtgaccaaattggttgaagagccttttgctctttttgaagagtcaggcaacctaccagcctatcaaggcggttggaccttgagccattttgatgcgcgtgaaggtgaaaattccattcaaatcggtgccaatcgcaaactctatgtgggcgaagtgattggggaaaccaacgaagatgacatccgtcgtatccagattcgggaaaccattgccagtcacctgcaaaaagaagaacgcctttacaaacgaggtatcaaggtgctatcccttttcttcatcgatgaagttgccaagtataagtgctatgatgagcaaaatgatgcctacaatagcacctatgcccagatgtttgaagaagagtatgaagcccaggtcaaggctttattggctgatctcaaccttcatggaagtaacttttggcattatctcaacaagcaccaagaaggcaatcctgttcatgcaggttatttctctgtcgataagataaaaaaatcggataaggtcaagtttgtggactacaagtctgctacggaaaagaaaaataaccagtctaacgacaaggatgcctatgatttgataatgaaggacaaggaacgtctgctgtcttttgaggaacctattcgctttatcttttctcactcagccctcaaagaaggctgggacaatcctaatgtcttccagatttgtaccttgaaaaatacaggtacagaaacagaaaaacgacaaaagattggtcgtgggatgcgtctagccgtcgaccaaaaaggtgttcgtcaggatgaggagcttttaggagctgatgttcataatattaacaagttgaccgtcatcgccaatgaaagctatgaagattttgctaagaacttgcaaagagaactcagggaaatcttggctgatcgaccaagcaaggtggaagtggatttttttgtcaacaaggtcttggaaaatgaagctggtcaaaaactgactgtcaccaaggaagtggctaaagagattgaacgccagttgattaagcaagattatattgacagcaaggggaatctgaccgctacttattttgaacaaaaagaaacaagtcagtttactctatctgaaaatctggcaggctatgaagtggctgtaaaagatattctagaaacgatttacgatgccaatcgctaccagattgaacgtgaaaatgattcggaagtggtttttgcaagagaaatcaaccctgataactacaatcgtcaagagtttaaacgtttgtgggaaagtattcatcacaagtccacctactatgtcgaatttgatgatgaggagttgattgaaaagtctgttaaggccttgaatgagtccttgtttgttaaaaagcctagttacatgattacagaggctgaagcaagggaaatgcaggcgaaacacggtttggatttcaaggtaaataagaacggcaagcgtcagtctgtgctggataagtcttctattcaactccgctatgatttgctgggtgaaattgccagtcgcacggagttgaaacggaaaacagtcgccaatattttgaagcagatttcgccaagcaagtttgatatgttttcctataaccctgaggcatttatccaacaagttagtaggctcatcaatgagcaaaaggcgagtcaggtgattgagcatatccgctacaatatcctagaggaaacttttgatagttctatttttacggacaatcctttgagtggtaaggtgtcagatgcaaatatgctcaagtctgagaagggtgtttataattatgtgaaggttgattctggaacggagaggaagttcaaagaggacttggagcgattcgacgatgtcatggtctatgccaaattgcctagcaagtttaagatttccacaccgctgggtgattacaatccagactgggccattgccttccgagatggttcggtcaagcatgtttacttcgtagctgaaaccaaaggttccatgtctagtttgcaactgaaaggggcggagttggcaaagattgagtgtgcaaaggcccacttcaaagccctaaaagaaaaaggattgattgcggatgatcggatttatgatgtggttgattcctatgaaaaattattagaaatcgtgagaggataggttgctgagcaatccttctcgccactgaaggagaatatttatgggtgcgtttctgttttttacatttgcgatttgttatctggtgggcattgttgccatagtcaaggcttttgttgtcccctgaaagaggctgggcaaaaactagccgctcatacataaaaaactccaaacgcgatacaataaaggtattcaagcctattgtaaagcgagaggagaaaagtatggcacaaaaggcacataatttatcacatacaaagtggctgtgttctaccacattgtcttcacacctaagtatagacgaaaaatcatctataatcaatatcgaagtagtttgggagaaatattccggcgtttgtgtagttataaaggcgtagaaattatcgaaggacatctgatgccggatcatgttcatatgttagtcagtattcctccgcgattaagtgtatcaagctttatgggatatttaaaaggtaagagtgctctaatgatgtttgataaacacgccaatctcaaatacaaatttggtaatcgtcatttctgggcagagggatattatgtaagtacggttggacttaatgaagccacaattaagaaatatatacaagaataaagaaattatccagtggatgatttcttcacgagcttcagcttaaaaagcgagttaaacatgatatagcacttgataaattgagtgtaaaagagtatgaagatccctttagggataatggcaagtagtacgaatgcctctttaagaggctagtgacgagtcaaaagcagtgaggcttgaacaaagtgaaagccagcgtctttaggcgctggctggtgatgtgggcttatagcccttgttcaaaccacccgtttgacgggtggtttgaactttctaatttatgtgactcttacccaacaaattcgttgatttctttttcgatgttggagattttttcttctgcttcagcaagtgtttcaccaacggttgcgatgtagaatttgatttttggttctgttcccgaaggacgaacagcgaaccaagaatcatctgccaaggtgtatttcaagacatctgatggaggagtagtgagtttttcaatgtttccatctttgtctgtcttagtttgaagggcaaagtcttcaaagaccgcgatgtcagtagcgttgaattgtgctggtgagttatcacggaacttagccatgattgccttgatttgttctgcaccatccttaccagaaagggtaacagagattgttttctcagcaaagtagccgtattctttgaagatttcatcgataccgtcagctaaggtcatgccacgtgaacggtagtaggcagcaatttcagcaaccataagcacagcctggatagcatccttgtcacgtacaaatggtttaatcaaatagccaaagctttcttcgaaaccaaacatgtaagtatggttgtgtttttcttcgaactcttggattttctcagcgatgaatttgaaaccagtcaagacgttgaacatggtagcgccatagctttcagcaatcttagttaccaactcagtagatacgattgacttagcaagggcagcgtttgcaggaagtgtacctgcttgcttgtgggcttcaaggatgtacttagcaatgatagcgccgatttggttaccagacaggttccagtaagaaccgtcagcttgacgaacttcaacaccaacacggtcagcgtcagggtcagttgcaagaaggacatctgccccgacttcacggccgagttcttctgcaagggcaaaggctgcttggctctctgggtttggtgaagcgacagtagagaagtcaggatcagcagttgcttgtgcttcaacaacttggacagattcaaaaccagcctgtgcaagggcacgacgcgccaacatttcacccgtaccatgaagcggtgtatagacaatcttcatgtctttaccgtattcagcaatcaattcagggttgatgttgaggtcattgagttcttcaagatatttaacgtcagtttcttcgccaagaaccgtaatcaaaccattttccttgctggcttcaaggtcagccaattcaactgcaaatggattgtcgatggcacggataaagttggtcaatgcatctgcatcagcaggtggcatttgtccgccgtcttcaccgtaaaccttgtagccgttgaattctttcgggttgtggcttgcagtcaccataatccctgcgatggcattgtaatggcgcacagcgaatgacaactcaggagttggacgaaggctttcaaatacataagatttgataccatgcgctgccaaaacttgagctgattcaaaagcaaattctggcgagaagtgacgtgaatcgtaagcgatggcaacaccacgttttttagcttcttcaccttttgattctaccaattttgccaaaccttcagtagcttgacggactacaaatacgttgatgcggttggtaccagcgccaatatagccacgcataccagctgtaccaaattcaagatttgtatagaaggcatcttcttttgttttttcatccattgcgactaattcttcacgcaagtaatctggaaggtccgcaaagtcgagccatgtttgataggtttcttgataagtcatcgcatatctccttaaaaatttttctattaaacgctttcattataccatgtttgaaaagaaaaatcacgctttcacatgattttctgatatttatttttgaattttctgtaaagttggaacaagcgctgcagttaatacagaagaaatgatcatttctgcaattgaattggtacctaaaacggttgctaacattgcttgaatattaccatcaaagacagaggagaagaggaagaaaatacctccaagtacaaaaatagtattggtcattgaaccaattgcaccagcaataaataatcctttacgattttttatccatttgtagacgaaataaggtgtaatcccgactaatatacgtgggacaactgcaatgatgattgaataaacattaccattttcaacaaatggggagaaaagatagctggttggtagtaagataatagtattatgggtcatactcattaagcccatgagagcccccaaacaagccccaacacgtggcccgtatataatagaagcaataatgactgggatatgtacgatggtgggttttattggaacaggcaatatattaaaaataattgaactcaatatattgatgacaatcatgacagcaaagaagattgcaattgtagcaatttgagttgatttattttttttcatcaagggtgttactcactttctctaaaatatcagttacctcagccaaggccccagttccaaaatctccacaagcaagcagggcttcacgcggtttgatttcctcaaaaccatactctatgagggttttgatatttttctgggtagcaggattgaggtacatgttagtattcatagcaggtgccagcagttttttagtaccaattggcagagccagcgctgttgccgtaataatgttgtcagccataccattagctaatttagctatcgtattggcagaagcaggggcaactaaaaatacgtctgtttctttggcaatatcgatatgcttgataagagtaggattttcttcaatcatgacatctgtgtggaccagattttttgacaaggattggagagtcaaaggtgtgatgaagtccatagcagagcgactcatgaggactgtaacctgatgaccgatcttggtcaattgactagttaggtccgctgctttgtaggctgaaatagagccagtaacggcaagtgtgatattagccattttgttctcctttttctagggtatttaaaatgagctgagcaatttcatcttttgtctgtgcttgaatctcccttgttttatcaaccaaataggcaatgtgttgattttctccaatatccttcaagtcattagcaagtatataatcagcgccatttcgttcaatgctttggcgagctacggcaaataattcctccttaggaacattaaccaatagtttgaagccaaagagtgtgatagctggattccatttttttacataggaaatgaccttgggagtttttttcaagaaaagaacttggtagtcatccttggatgaaatcttactttctgtattctgtttttttagtagactagaaatgtcttcagttgctcttagttcatctaaaccagccatataaacaggtgtataatcggatacagccatgctatgaatcagagcctgatgtgttttgactaaaggttctaatgtttctttcaaactatcaacatttgtgatttcgataatggttaaattcttctgagaatctggtttaacagcctgtcttgtagtcacaagagtaacttcatgaccgcgtttcaaggcttgttcggcaatgatttttccaagatttccagaagcatggtttgtaatagcgcggacttgatcgatagcttcgcttgttccgcctgatgtaatcaatagtttcatgttcatattttactagaatttctatttttcgtaaagtttgtactaatctatttgctaatcaatctgtgacactggaaaatgatgctgctaatacaaaaaatataagggcctgtattatatagtgaagtgtttttgtgcaagaaagcgttggtttgttaatcaaggcaatttttaaaggaatactgactctcttttgaaaaaactaactaaaaccagccttagatggaagtgtagagctatgatgagaatgcagtttttaaaaatttgtatctgtttaagtaaggaaacctgtagtttttctgaaaattccgtacgttagtgaataaatagtaaaaaaatatgcgaaaataagttgtagtatggtataatatccataaaaaataaggaaattaggtactctcatgaaaacagatattgacattgcacaaagtataaccttgaaacctatcacagagatcgttgaaaaagttggtatcagttttgatgatattgaactatatggaaaatacaaggcaaaattgtcttttgataaaatcaatgcggtgaaagacaatgcgccagggaaattgatcttggtgacagctatcaacccaacgccagctggtgaaggtaaatcaactattactatcggtttggcagatgccttgtctaaaattggcaagaaaaccatgattgccctccgtgagccttctttgggacctgtcatggggatcaaaggtggagctgcaggtggtggctatgctcaggtcttacctatggaagacatcaatttgcattttacaggcgacatgcatgccattaccacagcaaacaacgccctttcagccttgattgataaccatatccatcaggggaatgtgattggcattgatcaacgtcgtattatctggaaacgtgttgtggacctcaacgatcgtgcccttcgtaaggtaacagttggcttgggtggtccgctcaatggtattcctcgtgaagatggattcgatattaccgtagcttctgaaatcatggcgattttatgcttggcgacagacatcaatgacttgaaagaacgtttggcaaatattgttatcggttatcgtttcgattgcagtcctgtctacgtgcgtgatttggcggtggaaggtgctttgactcttattttgaaggatgctattaaaccaaaccttgtccaaaccatctatggcacgccagcctttgtccatggcggtccatttgctaacatcgcccacggctgcaactcagtcctcgctaccacaacagctctgcgtttggcggactataccgtcacagaagcaggatttggtgctgaccttggagcagagaagttccttgacattaaggtgccgaacttgcctaaggctccggatgcagtagtcattgttgccaccctccgtgcacttaaaatgcatggtggtgtagctaagacagaactttctgctgaaaatgtagaggcagtgaaagctggtttttctaacttgaagcgccacgtggaaaatatccgtaagtatggtattccagctgttgtagccattaatgaatttgtgtccgacaccgcagcagaaattgctgttctcaaagaactctgtgccgcaatcggtgtacctgtcgagttggcaagtgtttgggcaaatggtgctgatggtggtgttgaattggctgagacagttgttgctactattgataaccaagcagccagctaccaacgtctttacaagtctgaggatagcttagaagagaaagtgaccaagattgttacgcaaatctacggtggtacaggcgttgtctttgagaagaaggctcgtaaccagctgactgaatttgctaagaatggctgggataagttgccagtctgcatggccaagacccagtacagcttctcagatgatcagtttgcccttggagcgccgacagactttgacattacagtccgtgaatttgtgccaaaattgggtgcaggctttatcgttgccttgactggagatgtcatgaccatgcctggtttgccaaaagctcccgtagctctcaacatggatgtggcagcagacgggacagctatcggcttgttctaacaagaatgaatataaaaaatccgctcaaaggcggattttttgtctattcagatagtttctcaaccgttcgataggcaagtaagccaagggaaatactcaagataggaaacaccgtctggaagataccagtgttgaatggtgaattaaagagaaaatggattccaaagcttgcaccgatccaaaatactccctgtgcttttgacatacctgtatttttcgtgagaagggctactaagccaatggcaaagagaagcgtgaaaacccaatgggcccaaccagcttgaccaacgcgttcaagaatagtttcaaagccgtctaatttattcatgaacatgtctctaaaaacaaaggtgatgtcttccatgatttggaaacctaatccaacaatcactccgcttaccaatgcattttttagtgtcatttttctacaaataagcagtacaagtagaacagttagccctttaccgatttcttctgccaatggacctgaaatagctgcaccccagtcatttaggaaatcattactagctttaacaatttcgagcaggaaatatccgatagctgtatgtcccagttcagaaaaagagatgctacttgttaagcctaaaagccagctaagccctataacttgtttggagatgttatagcgtttagctaaggaatatgtcagtactagtaggggaatgaggtagatagcgaccaaggaaatggttaggagaaagagagaatatttagcttccatgccatttggcttacctaattctccaaagataattttgcaaccgttgacaaatccaatcgttgctaagacgactggaagataagttttacacatttgaaatttttctttcatagtttgacctttctgtattaataaactagtgtacggatacattgtatcaaaaataagtacattttgtctattattcacctattttttatctaaaccttctcagttattgtaatgttttttcctgcaactaggactccataataggccgtagcagaattgtgccaaaaattttcttttttgatagactaatgttgaaaaaataaaggagtattttatggaacaatatgatttagtagtcattggttttggaaaggctggtaagaccttggctggtaagctgtcagcagctggaaaaaaggttgccttggttgaggaaaatcctgttatgtttggcgggacttgtatcaatattggctgtattccaaccaagaccctcttggtagcagcagataaaaactggacttttgagcaggtaatggagcaaaaggaaacagtcaccactcgtctgcgaaacaaaaacgaggcagtcttgaaaggcagtggtgctaatctttatcaaggtcacgcgcgttttgttgcggacaaagtcgttgaagtgtcggccggtgaagagtcgattcaactgactgcggaaactattgtcatcaacacaggtgctaagtcgcgcgtgcttccaattccaggtttgttggatacagctcacgtttatgatagtacaggcattcagaacttggaaactcgtcctaacaagttggcaattatcggtggtggtaacattggattggaatttgctggactttacagcaaactcggcagccaggtgatggtatatgaagccagctctgctattttaccaagagaagaggaaggagtcgctcagctagccaaggagtatatggaagaagctggcatgacctttgtcttgggtgcgaaaatcgagcaagtcgcagctgcgggcgagcaagttgctgtgacggtcaatggcgaaacagcaattttcgacgctgtcctctatgcgacaggtcgggtgccgaacactgctgacttgggcttggaaaatacggcgattgagcttttggaaaatggtgctgttaaggtggatgactaccgcgaaacgactgttccaggtgtctatgcggtgggagatgtcaatggcggtccacaattcacttacacatccctagacgacttccgtatcgttttcggcaagttgactgggactggaacttatagcttgagccaacgtaagtctattccgaccagcgtctttatcacgcctgtgctttctcgtgttggtctgaccgagaaggaagccaaggaagcaggttacgactacattgccaacgaattgcttgtcgccaatatgccacgtgcccatgtcaataatgacctcaaaggcattttcaaggttatcgtggataaggaaagtaagcttgttctgggggcgactctctttggtcgcaattcagaggagctgattaacttgattgctatggcgattgacaataagattccttatacctacttcaaaacacaaatcttcacccatccgactatggctgagaatttgaacgatgtctttaatttttaatagtgtaataaccgtccaatagggcggttttttgtcggtcagcacttgcaaatatggtataatgattgataagaaaagactaggagagttgtatgataagaaaggaacacaatgagtttacaagagttcagttgccagctgctttgcatttgactcggcttggatatgactatctttcggctacaagtgaagacataaaaaacagagaccattcaaccaatatccttctatcaatttttaagcgacagtttttaacattcaataattacgcaagtgaagctgattttgaacaagaatttgaaaacattcgcctggaattagaacaagatgatttaggacgaagtttttttaatcggattcatgcagattctggctacacctatatcaattgggataatatggaagagaataccttccatatagccttagaagtcacctgtcaaaatggtgaggaagagttccggcctgatatcaccgtttttatcaacggtctccctctcagttatatcgaagtcaagcaaccagatgctattcgtgatggaaaaacaggaattcactctgaaaaagaacgtgccaagctccgctttgaaaataaaaaattcagacggtttaacaatatcacacagttgattgctttttcagacaatcttccctatgatgatagccaaggacaacagttgcaaggttcttattactgcaccaatgcttcatctggtaccaagttcaactctttcaaggaagagcaggagggacaagtacagtctagcctgtctagcttaacagaagagatgattgatttggttctcacagatgtcaatcgttttgccctcaagtcgcaagttgaattccgaaccaacttggatcctgcaagtccttgcaattcctttttaacttccctttatcagaaagaacggctctttttcatgctccgctatggtctagtctatgtggaagaacgagatgagcatgaccagattcaactacaaaaacacgccatgcgctatcctcaatattttgcgaccaaggcaattgagcgaggattggaagaagggatgaagaaaggtgttatttggcatacacaaggttctggaaaaaccgctctagcatttttcaatatccgatacttacgagacttttatgctaaaagaggtgttgtcccgcagttttactttgtggtagaccgattggatttggctgatcaagcctataaggaatttagcaagcgtggtctcaaagtcaaacgaattaacaaaccaagcgagttaaatcagattcaagaccagcaccatgtttctgttgtcaacatccaaaaattcaaagaatcctctgatttgacagatcattcaggctatgacttgaatcggcaaaatatctacttcattgatgaggctcaccgttcttacaatgaaaaaggttcctatctgccaaatctatataatgctgataaagaagctgttaaaattgcactgacaggaacgcctttgattgcgacaaaggctgacggtaaaaccaaggaaacagctgtgacgactcgtgatatctttggggactatatccacaaatactactataatcaatccattgctgacggttttaccctacggttgatgagggaagatattgaaacttcttacaaggaaactctacaagctgtacacgaagagattcaaaaaggctccattgaaaagaaagaaatttttgcccacccccgttatgtctctccaatgctagactttattcttgatgattttacaagagcacgagagatcttatttggcgaccagtctatcggtggaatggtggtctgtgattcttcagaacaagcccgagaattacacaaacagttagaagaccgtcgaaaagcagggcttacatcattcacttcaaccttgattttacatgatgctggggataaggaatacaagaaagaagaagtggataaattcaaggacggtctgatagactttgtcatcgtctactccatgctcttgactggttttgatgcaccaaggctgaaacggctctatcttggacggaaaatcaaggcccataatctcttgcagaccttaacccgtgtcaaccgtccgtacaaggattatgcttttggctatgtcattgattttgcggacatttccaaggaatttgacaagaccaataaagcctatctggaagaactcaatcgggaataccaggcagctttgacagaagaagacggagataatccttttggaactatttttgtgtccccagaagaagtccaggaacagctagcgagctctaaccgagttctaatgaactatccgacagataacttagaatttttcggaagagccatcgatgaagtcaaggataggaaagagttaatcgccctccgaaaatctcttgaaaccattcgtcagtactacaacatggcacgtttgcatggttaccacgatattgtcaaacaggtcaatataggagaaattgctagccttttaaatatgctgtcccgccgcctcttgactttgaacttgttagaaaaaccagatagtttttctagtcagcaactactgaatctagccatgtctgagactagctttagttttaccaagataaaggaagaggaactacgactggcagccaatgatttggacgatatccgacgccgtgtggccaatggtatcaatctacggagagatgaaaaagatcctgaatgggtaagtctttatgaagagtttcaacgcatcctaaacaagcacatgacacaggaagtagaaggatatagtctctcaaccattaaagaaaccaaacaagcctatcaaagtttattcgattcagtagaagactataaaacaagaatgaatcgcttggccatgaactttggtggagataccatgtctgcccgtgcctttaagcacattacccaatcaacagttgtcagtgacttcccagctatttatcaggtgctaaaaggtgccaaacctctgattgattatcaaatcgggctcaatcaaggcattctggaaaacgaagcctatttggtagcgcagatcaggcaactggcccgtaaagaaatgatgaaaacagaagtagggaagcaactcaaacgagtcgattatgataagttgattcgttccctaatggaagtctatgaaggagaatattaaacaaatggaagaacattatatcgtgcaggtgcaaagtcaagtacaaggcttggttgatgacctaaaagccgtctttacccatgcaggacttggaggagaagcgggggagtacaaacttctgacccagtccttcctttacaagttcttaaatgacaagtttttgtatgaagccttgatcgttgacaatcgttatgactatcaaggtcttttggacttgtctgaagaagattatgactggtttttagatgatattgggactaaaactgctcatctaaaacctgaacagctgattgaaagcctacaccgtcaacagaaccaagcagattttgctgagatttttgaacagactctcaatcagattgctattgacaacaatgctattttctctgtccatacggacggtggaacagatattcgcctctttgatcaacgcttgattacggatacgatttcagatgccagcaagcgaaatgaagtggcagcttctattatcaatctcttggcgcgtgttaagtttgatcagcagattttttcacagggctttgactttttctccaccttgtttgagtacatgattaaggactataacaaagacggtggtggaaagtatgcggaatactacacacctcactctgttgccaaaatcatcgcggccattttggtgggcaatgaccaaccaagtaatgtcaaaatctatgatccttctgctggttcggggactctcttgatgaatctggccagtcagattggtgatgaatctggccagtcagattggtaccgaccgtaccagcgtttacagtcaggatatttctcagaaatcctccaatctcttgcgtctcaacttgattctcaatggcttgcagcattccattcacaatatcgtacagggaaataccattctcaacaatcgtcatgtggagaagatggactatatcgtgtccaatcctcctttcaaattagatttttctgagtggcgagatcaggtagaaagcctgccaaatagcagtgaacgtttctttgcaggtgtgccaaagattcccaacaagaaaaaagagagtatggctatttaccaactctttatccagcatattatccatagtttgaaggaagacgggcaggcagctattgtcttgccgacgggctttatcaccgcccagtcaggtattgacaagaaaatccgtcagcaccttgtcgatgaaaagatgttggcaggcgttgtgtccatgccgtccaatatctttgcgaccacaggcaccaatgtgtccattctctttatcgataagaagaataaggacgatgtggtcttgattgacgcttctaatcttggcaccaaggtcaaggaaggcaagaaccaaaagacagtccttagccctgatgaagaaagccaaatcattcagacctttattaacaaagaagttgtcgaagacttctctgtcaaggttagctatgaagagattaaggataagaactactccctcagtgcaggtcagtactttgacatcaagattgactacgttgatattagcccagaagaatttgaagaaaaaatgcagggctaccaagaccgcctagctaacctctttgcccaatcgcatgaattggaaaaggaaatagcggagcaggtgaggggggtgaggtatgagtgaggtaagatggcaaataaagagtttgtctgaactgggaagattttcaaggggaaaatctaaacatcgtccaagaaatgataaaaaattatttactaatggaacctatccgctaatccagacaggtgatattaaaaattcaaatctttatgtaacaaagaatagtgattattataacgaatttggtttgtcacaaagtaagctatggaagcaagggactctttgtattacaatagcagcaaatattgctgaaacagcgattctatcttacccaatgtgttttcctgatagtgttgttggttttaatgcacataaaaatgaatcaagtgagttgtttgtttattatgtttttgaattaataaaaaaagaaattcagaagacatctagtggtagtatccaagataatattaatatcgactacttaacaaaattaaaattaaaggttcccaacaaagattatcaagatagaattgtcaacttattgtcaactattgataaaaaaatcttaattaataaccaaatcaacgaggagttggaggctatggccaagacgctttatgattattggtttgtgcagtttgatttccctgatgaaaatggtaagccctacaagtcctctggtggtaaaatggtctataacgaccaactcaaacgggaaatcccagaagggtggggagtgaagcagttgggtgagatatgtgaatttagaaatggaatcaattatgaaaaatctgagacaggggatacgctttcaaaaattgtaaacgtacggaacatttcaaattctagtacttttgttactactcatgatttggactcaattactttagatagaagacgtattgaaagctatcttgttacagatagaacaattctgataactcgcagtggaattcctggggcgactaggatagtctctgatattccagttaacacaatttattcaggttttattattggtgcaactgttgccaatttgaatctattttattatgtattttatcatctaaagaatattgaaatgctcatgtctaatcaatctgcgggaactataatgaaaaatatttctcaaactacactttcagaaattcgcattgtgatcccaaataaagaaattcagaaggtattttcaaatgaagtcagaagtcttttagatgtaattgaaaataatttaaaacaaaaccaagaactgacccaactccgtgattggctcttgccaatgctgatgaatgggcaggtgaaggtagaggagtaacgaaaatagaggtttatgctatgagtgaattaagcaaggtcacgatcagaatttctggtaaagcaatggatgaatctaaaggttacgaacttaaatatttgttaaaatctttggatagtttttccaagttatcagaaaagacgtatttacatatgataagcgaagataggctcaaaaagagtgaaagtggtaattttgcactatatattgacaattttcaacatggttctttcttagctgatttagtaattgtaatgaattcatatgcccttcctttacttgaacatggtcaaactatttggggagctatcacaactgtttatgattttataaaaacaatttcctctgccaaagaagaaggtaaatcggtaagtattgagaatgtcggtgatggttcaatagccgtagcggtaagtgacagttcaagtgttggagatattacaataaataactatctatatccagaatatgtaagagaattatctccaaaacttgctccctctttctccaaattggttcattctattgatgaaaatattgatgaaatctcatttaattctagtgacggtaggggcttcaaggttagtgagaaagatataaaaatatttgataaaaaagaatttctttcttccgaagagattcaaatttcgggcacaattacagttttaaatacacatgataacactggaaaaatacaaattgaatcaaatgaaattccgttgggtgaatataaattcgatgttcaaaaacagattcgctaccctgaataccttagttcagctatgagaaagaaattgagatatagatgttatcctaaaataaatttcgatccgtcaactttgaaagagaaagttattggtgtgcggattattgaaaaattgtagttcaagaacattcaatactttcagaaaataccccctaatcatgttgactagggggtatttttctaagtcgtttctatctcttttccttgcggtaaggttgttacaatgtttattgtagcggagttagtttctgtttgatttttctgtcgcgttctttctgaaaaatcttggcgaatatcatttaggacttgcaagataactttttcaggggctgttgggtcatagctgattttattgaccaagtgactataaaggagggtgtacagattgaaggctgtttttcggacttccaagctgtttattttttcgcgagtgctggtgtcctgacttcttttcagatagagacgatatgtactttcatggctttcacggagattggcaatagcttcatctaacataagtaggctaacatcttctgagtagggtggcttcgccagtcgggctagcaaagaatcaatcaaagcagatgattcttgcatattggtagaccttgtatttttgtatagtttgatgagttcttgtagtcggtgataggcttgtaatttctcgggtgtccgagtatttttaaaaagtttgagtccgttgacgaaggcagagtagtcagcctttcgattctttagagccttgtttaagttactagtcatgtctgagccacgtttttgtttgagactttttttcagtaagggtaaggattcttcaagctgtttgattaagtccgttaccatggggtcattggtggaagaactgtactgtttcaaggtatcaacactacttgtgatcaattgtgtaaattctgcttgattcagatgttgtgcatataaagggattcggattttcatttgtgtacctcactatctttttttccggtcatcttatttattcgtaaataagtagaaaaaaatagaattatttaaaaaattttttaaaacttgtcaaaacagtacatttacctataataaaattgtgtttttaaggaattgcatcaaaacacaatgatataaatgtttggaaatagcaaattagtttgacttgcatatttaaaaattgtttttggaataaaattattgattaggcttgttttcaaattgaaaggatatgatctcagtttgtttattgaataccttgcacacatttttctttgtttaggcaattccgtggtacaataaggtatcaaccattggaggttttatatgaaatggaataaaaaactagcacttagtgctgtcttagtcgcaagtttgtttactttgtcagcctgtcagtcgatttcaaattggtggaaaaataccaaggaagaatggattggcttggagatgacggtacggacttatgatgaaaattctcagttgatagatgaaatgtctggtaagtccctatcgatttcgcggaatcaggaatttgactcggtggatgccgaaggctattccaatgcggattcttctgtcttgaaggtgacacttgggaattacgaaattgaccacgtaggctcatctttgattgcggcagaagaaggtttggaagacttgtatgcgaaatatcagaccacagtagatatcgcaaattacgatcgtgcaattccgcttgttaaccgtatggtatctagtctcaaaaatgattttacaggtaaggcaaaggtggtcttgattcgttcgcaaaacggaaccccgcttgctacttatgtaggtgataaagtatctctttatgcatctgatgcacctaagacttctgaactcttaattgatggcaagcggttgattatctaccgctgtgattatacaatttatgatagagaattattggagaactaaatgatagacattcgttccgcaaggatagaggatgcggcagaccttgtggcaatttatgctccttatgtagaaaagaccgctattacctttgaaacagaagtaccgactgtcgaagcctttgcaagtcgaattgaaaagaccttggagaagtttccctatctggtcgcagtagaagaaggtaaagttgtgggttatgcctacgcttcaacctactatgcccgtgcggcttacgattggacggtggaattatccgtatatatcaagcaagaagcgcgcggaaaaggaattggaactcttctctacaatgctttggaaaaggacctgacagcgcgtggttttaaaaatttcttagcctgtatcgccctaccaaacgcagcctctatagcactccatgagaagaggggctatgaacaggtggctcatttcaaaaaagttggttataaatttgatacctggcatgatattgtctggcttcaaaaatctcttgtaggtaagcaaaatgaagattaacgaattagaaaaacgtttgttggccgtggcggatgctagtcaggcccagcctatgaaagcttatatgaaaaataactttgaattcttaggtgtacgaacgcctgaccgccgaaaagttgccaagcagtttttcaaagatttcaaggctcagggaattgactgggactttgtagaggcttgctggtctaagccctaccgtgaatttcaatatatcgctattgattacctagttaccaagaagaaagacttggttctagctgatttacctcgtttgaaagagctagctcagaccaagtcttgatgggatagtattgacggtctagataagctagttggtaagattatcttggaaaatccagaggccaagcagacaatcttggaatggagtttggataatgatttctggttgagacggattgccattgaccaccagcttctccaaaaagaaaagacagatacgaaactgttggaacaaatcctaatcaataatctcaatcagactgaattttttatcaataaggcaattggctggagtttgcgggattattccaagaccaatcctgaatgggtacgagtttttcttaccaagtacagctcacaaatggcaggcttgtccattcgcgaagccagtaagtatatctaggaggagccatgtccaaagtctatgaatttgaaacccttatccatccagtaccggataagggcggagcctatatcatctttccctatgatatacgagaagagtttggtaaggggagggtaaaggtacatgccagatttgattgtcatccctatgatggctccattgtcaatatgggagttaaggatgaagcaggcaatatctgttatattattggcgttcaaaaggctattcgagcggctattggaaaacaggctggtgatagagtacaggtaaccattcaagaacgaatggagtaatcaggcttgcaaatccttgagattatggtagaatagaatcatgcgatgagccgagtagtggggggattaaggttcagcacacttctaagagttcgtgtcaacatctcagcgcagtggttgattggcagatttgttcgtattttatactccaaatctgacctaatcaactgtgcgggggtgggaagacgaactcttggttgacaagttgagttctttcccactcccttcgacgctagggaggtcttcatttaattgaaacgcaggagcggaccttgaatagttgtgtgaaccttctattctcatcggaaacgatgcccttgcccacctttatggtgggctttttgtatactaagtgaggctgggcaaaaagccctggcccacttctcagtgttcgtgtcaacatctcagcgcagtggttgattgggtttaacagtccagtggactgttaaaggtaggagataagatttgcgaagcaaatctcagcaattcgtgttttacactcgaaatctaacctaatcaactgtgcgggggtgggagtgaaacagtctggggatagactgtttcagctcaacaacttaaaacgaaaaattgttgacgaaccttttttgacttagtcgatgtctttcccactcccatttcagtatgtgatttctataggaatgctattggctcagccgaggaagtttttatatttctcaaagttagaaataacagttgatattatgtttgatgaagattgcttgatagtcttttaaatcttctggatggagagccttgacatcggtcatagcataggttcgattgagaagcttatacttattttctccaaattgatggaaggggagtagttgaactttgtcaatcttgagttgattaaagagacaggcgaattgttcagcatcttcgagggaattattaaagtcagggataacagggatacgtaggacgatttctttcccgatggaaaaggcgtattggatattttgtatgataaggttattattgacgccggtgacttttctatgagaaattgtattgtaatgttttaaatcagtatagataaagtcaacgtattggataaggtcaacaaatttgtggtgttctacgaaagcggtggtttcaatagcggtatgaaggccgtgtctttttgcctccataagaatagctttcgcaaactcatattgggcaaaaatttctccgccagacagcgtgagcccaccacctgattcttcataaaaatcaatatctttcatgacttcggatatgatgtcatcaacagatttttcttctcccatgatggtcatttttttactaacagcatcaagcatgggttcaggttttcgtttttgagattctggatttgcacaccaaggacaacgtagggggcaacctttcaagaaaaccgtcgtacgtataccaggaccgtcatggagcgaaaaatgttgaatgttaaaaataatgccttttcgtgtattcatgctctttctccttttcgattaatttgattttatcacacaaaagaaagttttacaattacgaacgtaagttaaaaagttgcaaatagttgaaaaagagtcaaaatttgatagaataatgatgaggtgatgaaatggaacgattagataaaattatacaactggtatcacaacatgaaaaaatagatgtcaatagcttggcggagcaactggacgtttctaaggtaaccatccgtaaagatttagataagttagaatcaaaaggtttattacgtagagaacatgggtatgctgttctaaatagtggtgatgaccttaatattcggatgtcctttcgctatgatgtaaaaaaacgaattgcaaaagaagcagcaaatctcattgccgacaatgaaacgattatgatagagtctgggtcaacttgtgctctcttggcagaagaaatttgcaaaaccaagagaaatgtgaccatcataacaaattcttattttatagccaattatgtgcgacaatatgatagctgtcagattattttattgggtggtgagtttcaaaaagattcccaagtaactgttgggccgctcttgcataaaatgattcagtttttccatgttgataaggcttttgtaggaactgacggctatgatagtgagcatggttttacaggtaaaaacttaatgcgaagcgaagtagtacagtacatgtctgacgttgctgaaaacatgattgtgctaacagattctagtaaatttacaaaacgagggacagtacgcagatttggtttaagtcaagttgctcaggtcattacagatacgtcgatttctgaagatcttgtcaaggaattagaaaatgctagagtcacagtaaggctagtttaggttgggggcagtatgaagcaagaaaaaagaaggcagttggcaaaaatagcctatctttactacgaagaggggaaaagccaagctgagattgctgctgatacaggaatttatagaacgacagtcagtagaatgttgaccaaggctaagtcagaaggcattgtaaaaatagaaattcaagattttgataggcgcctatatcgactagaaaaatatgttcaagaaaaatatggattaaaaggtttagaactggttgaaaacagcaccgatgaggaccagcttgatttagaaaatcgtctggcacaggctgcagccgatatgcttaccaatctaattgatgatggaaagaaagttggtttttcatgggggagaagcctcagtcttattgtagataagatagggaatcatcgtatgaaaggtgtcaaatttgttccaatagctggcggtccaagtcatatccacgcacgttatcatgtgaatactctgatttacgatatggccaataaatttcgtggagaatgtagttttatcaatgcgacgattatccaggagaatcaagaacttgctcaaggtattctttcttctaaatatttcgaggagctacgtgctgactggaaggacttagatgtagcagcaataggtattggcggtcgagtcgatgaaaaaaatcgtcaatggttagatatgttgacgacggctgattttcaagccttgtcagatgaaggtgcagtcggtgaaacctgctgtcgtggtctgaatcaatacggtcaagctgtcgtggaggatttgcaaaagaggaccattgccatctctttagatgatttaaaagaagtcccagatacaatagctcttgcatatggggaggaaaaggctcaagccattttagctgtattgcgagctggctacattcatcatctggtaacagatgaacgaaccatcgtaaaagttttagaactggataatgatgtgcatgtccatacaaatttgtaagagagtacttcaatcacttaaaggtggttgaagtattttttatcccaaaaaatgcacaaaagtgcagaaataaattaaaacagaaaatgttctataaatatatttacgctataaagagaaaatgatatgatttacttacgaaagaaatataataacttacaaataaaacaaatcggaggaaaaagaaatggaaatgattgttgcagatcaattgatcatgggattgattatttatgctggagatgcgaaaagtcacgcctaccaagctttgtcgcttgtcaaagcaggtgaagaagagcgagcagaagaggaattagaattggcagatgcagcattattagaagctcacaatatgcagacaaaattcttagcacaggaagctggtggagcaaaatctgatattacagcactatttgtccattcgcaagatcatttgatgacgtctattacagagatcaatttgattaaagaaatcattgatttgcggaaagaactaaaaaaagttggctaaaacaaaaaaattatatttaggaggaaaccgaaatggttaaaatcgctctattttgtgccgctggtttttctacaggcatgttggtaaacaacatgaagattgcagcagcagacgcaggtgtcgaagtagaaatcgacgcgcattcccaagggaaacttgcagattaccttgacgaaatcgatgtagctttactgggaccacaagtagcatatacgcttgataagtcaaaagcgctctgtgatgaaaagcaagtccctattgccgtgattccaatggcagactacgggatgttggacgggaaaaaagttcttcaattggcactcagcatggtttcataaaggagtatggtcatgtccaaaattgatacacaaaaaattattgtcccaatcatgaaatttgtgaatatgaaagggatcatcgctctaaaagatggtatgttggctatcttacctttaacagtagttggtagtattttcttaattttggggcagttgccttttgaaggcttaaatgccgcaatagcttctatatttggagcggaatggactgaaccgtttatgcaagtctatagcggaacctttgcgattatgggcttgatttcttgttttgcgatcggctattcttatgccaaaaatagtggagttgagcctctccctgcgggtgtactgtccttgtcttcattctttatcctcttgaaatcatcttatattccagttgatggagaaccaatcggtgatgccatcgcaaaagtatggtttggtggtcaaggaattatcggtgcgattattattggtttggtagtgggcgctatctatacgacttttattcagcgtcatattgttatcaagatgcctgaacaagtaccgcaagctattgccaagcagtttgaagctatgattccagcttttgtcatctttttgctatctatgattgtctatattgtttccaagatggcgacaaacggtggtacattcattgaaatgatttacgatgtgattcaagtgccactacaaggtttgactggttcattaccaggtgcgattggaattgctttcttcatttccttcctctggtggtttggtgtacatggccagtcagttgtcaatggtgtcgttactgctttactattgtcaaacctcgatgccaataaggcccttttagcagcagataaattgtctctggaaaatggcgcccacatcgtgacccaacaattcttagatagtttcttgattatgtcaggttcaggtattaccttcggtattgtttttgcaatgctatttgccgctaaatcaaaacaatataaggctcttggtaaggtagcggcctttcctgcactctttaacgtaaatgaaccagtcgtctttggttttccaattgtgatgaatcctgtaatgttcttaccatttgttttggtaccgatcttagcggctttcattgtctacggtgcaatctcaataggctttatgcaaccattttcaggtgtgaccctaccatggtctaccccagcaatcatttctggttttatggtgggtggttggcaaggtgcagttgttcaaatcattattttagctgtctcaactattgtttatttcccattcttcaaaatccaagataagattgcctatgaaagtgaaacgaaagaaccagtttagtcaatgatgtcagacaaaagagttgcacaaatgtgcagccggcttcggaaatcttagcgctcactagcatcaattgacaataacccctattacaggatatacttaatttacaaacgaaacaaaattaagtttcgaaagaaagggtaaaactatgaaaacagtgactgaagtagctggcactagcattaaaactgagtattttggaagtctgactgatcggatgaacaaatacagagaagatgtccttgataagaagccctatattgacgcggaacgggctgttttagcaacaaaagcctatcaagaacatagagagaagcccaatgtattaaaaagggcctatatgctcaaggaaatattggagaacatgacgctttatattgaagaagaaagtctgattgcaggtaaccaagcttcttcaaataaagatgctcccatcttcccagaatataccttggagtttgtattgaatgaattggatttattcgaaaaacgggatggggatgtcttctatattaccgaggaaactaaagagcagttgcgcagcatcgctccattctgggaaaagaataatcttcgttcacgtgcaggtgtcttgcttccagaagaagttcaagtttatatggaaactggcttctttggtatggaaggtaagatgaactctggcgatgcccacttggctgtcaattaccaaaaggtattggaacaaggtttgcgtggttttgaggagcgagttcgtgtagcaaaggctaatctcgatttgacggatcctgcaagtattgataaatatcatttctatgactcaatctttatcatcattgatgcggtgaaagcatacgcagatcgttttgtcgccttggctactgaattggcagagaaagcaccaacagctcaacgccgtcaagaactactggagattgcacggatttgtgcgaaggtgccgtatgaacctgctgaaacatttgcagaggcagtgcaatcggtctggtttatccagtgtatcttgcaaatcgagtccaatggacattctctatcctatggacgtttcgaccaatacatgtatccgtatgtgaaagctgatttagaagcaggacgtgaaacggaagacagcatcgtcgaacgcttaactaacttgtggattaagaccattactatcaacaaggttcgtagtcaatcacataccttctcatctgctggtagtccactataccaaaatgtaaccattggtggacaaacacgtgataagaaggatgctgtcaatccactttcttacttagtattgaaatctgttgcccaaacacacctgccacagccaaacttgactgttcgctatcatgcaggcctagatgctcgcttcatgaatgaatgtattgaagtcatgaaacttggttttggtatgcctgcctttaacaacgatgaaattatcattccctcctttatcgagaaaggtgtcttggaagaagatgcctatgactacagtgcgattggctgtgtagaaacggctgttcctggtaaatggggataccgttgtacaggtatgagctatatgaacttcccgaaagttttattgattaccatgaatgatggtatcgatcctgcatcaggcaaacggtttgcaccagcctttggtcacttcaaagatatgaaatcctttgaagtgcttgaaacggcatgggaaaagacacttcgtcatctaacacggatgagtgtcatcgttgaaaatgcaattgacattgctttagaaagagaagtaccagacattctctgctcagctctgacagatgactgtatcggtcgtggtaagcacctgaaagaaggtggagcgatttacgattacatttctggtctgcaggttggcattgccaatttatctgattctctagcagcaatcaaaaaattagtctttgaagaaggacgattgactccagaagaattatggcatgctttggaaacagactatgctggggagcgtggtaaagaaatccaggaaatgttgattgaagatgcaccaaaatatggtaacgatgatgattatgcagaccaattggtaacagcagcatatgatatttatatcaatgagattgccaaatatccaaacactcgctttggtcgtggtccgattggtggtatccgctattcaggtacatcatccatttcagccaacgttggacaggggcgtggtactttggcaactccagacggtcgcaatgcaggaacaccgttggcagaaggttgttctccatcacataatatggataaaaatggaccgacatccgttttgaaatcagttgccaaattaccaacacatgaaattgttggaggcgttctgctcaatcagaaggtcaatccacaaacacttgccaaagaagaagacaaacaaaaattaattgccctcttgcggacattctttaaccgcttgcatggctatcatattcagtacaatgttgtctctcgagaaaccttgattgatgcacaactacatcctgaaaaacaccgtgatttgattgtccgtgtagcaggttattcagcattcttcaatgtattgtcgagagcaacacaagacgacatcattggtcgtacagaacatacattgtaaaagaggttattattatggaattcatgctggacaccttaaatatagaggaaatacgaaaatgggctgaggttttaccccttgcgggggtgacctcaaacccaacgattgcgaggaaagaaggtgacattgacttttttgaacgtttgcaccttatccgtgacatcatcggtccaaatgcttcactacatgtgcaagttgtggcaaaggattatgaagggattttggcagacgctaaaaaaattcgtgaattggcaccggaaaatatctatattaaggttccggtaacgcctgctggtttggctgctatgaaaacattgaaagcgcaaggttatcagattacagcaacagcgatttataccgtttttcagggcttgttagctattgaagcgggtgcagattacttagcgccgtactacaatcgcatggccaatctgaatattgattcgaatgcggtcatcgctcagttatcagaagcgattgatagggagtgttcggaaagtaaaattttagcagcatcattcaaaaatgtggatcaagtgaaccaagcatttgcaaatggggcgcaggctattacggcaggtgcagatatatttgaagcagccttttctatgccatccattgaaaaggcggtaaatgattttgcagatgattggtctgccattcatggaaggtatactatctaaacatttctatattataaaataggggggcactatgaaacaattctcaggtctttcacgcactatccaaggaaatcatcttttagacacttgtgcgattgacattttgaaaataggtcatcgtccccttgttttatgtgcaaaacaggagtataatacaactgtagaaagttttgtgaaagttttaacttgtcatggacttattgttaaaatagcctatatggaggagtgggaccagaactcggttgaagaatatggggaagttggtttccgacatcgtgcagaccatattattggcattggtaatagttctgtggcagcttgtacaaaggctgttgcagatttactagacttgccagctgttcttataccgacttcacagtttaccactctaccttgggtatcggtggaaaataagaaaagagagcgaccattgtttaatgagtccatccagctaattatagcggatagggagcaattattgacacaacctacctcggagttgataaatggagtggtcaatactcttctttatctagcagccataaaagaagtacaaagaaatcatctattcagcttgatagatgatattcttatcagagattttgaaagcgttttattaagaagtagtcttcaagctatagagaattttgaagctcggatattatcaaaagaagtacaagatgtcttagaagttctttctacttgtgtaacattagacctgcctagtgatgcttgggacgtgattcaacaaatagaatcaaagctcagcgaaagaagagaggatttggtggatgagccattgaaacgaaatgttgtcctctacttgcttctgacctatttgacacaggaatcagaagaatttcaagccagactgaagtggagtcaacagttgcttttgtctgccaactctagcaatctattgtcgctggaggcagttttcaaggaaattgcactagagatgggagaagatggctcgacacgttgttagtaggcatcgctgtacaatggcaatatttaaaatgcaggctcatacctcttactttcggcaatgctcactgtcgtttattactcaatataacactatctattatttcaaggaggaattcttatgaaagtatttgcaagtccatctcgctatattcaaggtaaacatgtccttttccaaggtgcagaagctatcggaaaattgggaacaaagcctttgattctttgtgatgatttagtatatgggattatcggtgagaagtttttgtcctatctcgttgaagaagggatgcaagtccatcgtgttgcctttaatggagaagcatctgacaaggaaatccagcgcgtcgtagaaatcggaaaagaacaggctagtgacgtcgtaatcggtctaggtggtggcaagacgattgactcagccaaggcgattgctgatttactaggagtgccagttgtcattgctccaactattgcttcaacagatgctccgacctctgctttatctgtcatttattctgaagaaggggcgtttgaacgctatattttctataagaaaaatccagatcttgtcttggtagatacagcgattatttgtcaagcaccgccacgtcttttggcttctggtattgcggatggcttggcgacgtgggtggaagcgcgtgctattttacaaagcaatggaacaacaatggcaggaggaggtcagacacttgctggtatcgctattgcacaaacctgtgaacaaacactctttgaatacggacttcaagccatggccagctgtgaagccaaggttgtgacagctgctttagagaatattgttgaagccaataccttgctaagtggtttaggctttgaaagtgcaggtttggctgcggcgcatgcgatacacaatggattcaccgccttggagggagacattcaccatttgacacatggtgaaaaagtggcttatgggaccttgacccagctctttttggaaaaccgtcctaaagaagaattggaaaaatacatccgtttctatcaagccttgaatcttccaacaactttggaggagttacatttggctgatgctagttatgaagaactattgaaagtcggccaacaagcgacgattgaaggagaaacaattcacggtatgccatttgctatttcagcagaagacgttgcagaagctctgatggcagttgactactatgttcgctcattagataaataagaagagcattcacagttgagcatgtccatctaaactggtgaatagaggttcgaagtaattgccttgggaaattctttctcagggcttttcatttgaaaaaattatgatataattgttaaatataaaatatttagaaaattttgaagaattgacttaaaggagatttctatggcctatgtagtagctgttgttggtgccactggtgcagttggtgcccaaatgattaaaatgttggaagagtcaacacttccaatcgagaaagtgcgtttccttgcttctgcccgttcagcaggtaagaccttgcagtttaaggggcaggatattgtcattgaagaaacaacagaaacagcctttgaaggagtggatattgccctcttctcagctggtggctctacatctgccaagtacgctccttacgctgtaaaagcaggagctgtagtagttgacaatacctcttacttccgtcaaaatccagatgttcctctggttgttcctgaggtaaatgctcacgcgcttgatgcccacaatggtatcattgcttgtccaaactgctcaaccattcaaatgatggttgccttggagcctgttcgtcagaaatggggcttggagcggatcatcgtatccacctatcaggcagtctctggagcaggtatgggagctatcttggaaacacaagctcagcttcgttctgtcttgaatgatggcgtggaacccaaagcggtagaagcgaatattcttccttctggtggcgataagaagcactatccaatcgggttcaatgctattccgcaaatcgacctcttcactgaaaatgactacacatacgaagagatgaagatgacaaaagagactaagaaaatcatggaagatgacagcattgccgtttctgcaacctgcgtccgtattccagtcttgtcagctcactctgaatctgtttacattgaaactaaggaaattgcaccgattgatgaagtgaaggcagctattgcatccttcccaggggctgttttagaagacgatgtggctaatcaaatttatccgcaagccattaatgctgttggtagtcgcgatacttttgttggtcgcatccgtaaagatttggacaaggaaaacggtattcacatgtgggttgtttctgacaacttgctcaaaggcgctgcatggaactctgttcaaatcgctgaaacccttcatgagcgtggtctagttcgtccaacggcagaattgaagtttgaattgaaataattttattaaccaaaagtacacaaaaggctgcactcagccttttttagcaacaatcagtaagagaggaagcctatgtctattcaagatttacgtgatgtaaaaattattacagcaatgattacccctttcaaagaagatggttcgattaattttgaagttttacccgaattgattgaacatctgttgtcccatcacacagaagggattttattagcaggaacaactgccgaaagtccaaccctgacacacgaggaagaactggaactatttggtgctgtgcaaaaaattgtcaatggtcgtgttcccctaattgcaggtatcggtacaaatgatacgcgcgactcgattgagtttgccaaagaagtggcggcattcggcggctttgcggcaggtcttgctatcgtgccttactacaacaaaccctctcaagagggaatgtatcagcacttcaaggctattgcggatgcctctgatttgccaatcattatctacaatatcccaggtcgtgtcgtggttgaaatgacgccagaaaccatgttgcgtttggctgagcatccaaacatcatcggtgttaaagagtgtaccagccttgctaacatggcttacctaattgagcataaaccagaagacttcttgatttatacaggtgaggatggcgatgctttccatgcaatgaacttgggagcagatggtgtgatttctgttgcatctcacacgaatggtgatgagatgtatgaaatgtttacagccatcgaacaacaagatattcgaacagcagccgctattcaacgcaagttcattccgaaagtcaatgccctcttctcatatccaagtcctgcaccagttaaggcggttcttaattaccttggatttgaagttggtccactccgcttgccgttggttccatgcccagaagaagatgctaaacgcattatcaaagtcgtagtggacggcgactacgaagcgaccaaagccactgtgacaggagtcgtaagaccggattattaaaatagtcaggggagtgactattttaacgtgagccttgaaataagagagcgaacaatgtctgggggagtgaaacagttcggggaactgtttcagctggtcaccaagaaatatgaaagtgaccatagaagacccgagccaagaaatgcgaaagcgaggatagtcaggggagtgactattttaacgtgagttagggcataaagagtgaggtgtttagaaaaatattaatctagaggagcttctggccatcttcctcgttttatttaagtttacacaagcacatcagttatctggtgtgcttttcagttgcaagccttttcaattttttggtcattcttgatataatgactaaaaacgataaaaggattaagtatgaatattgttattataggcgcctcctttgctggtttaagtgcagctttagaatgtcgaaaattgtatcagaatgctcaaataacactaattgatagagaaaaagatgtggcttactttccaaataccttgaattggaaagtggcaggaaaaatttctggttgggaagaagcgaagatttctttgttcagcgaggtgcagcatgcagctatttcttgtctttttgaaacagaatgtctcgcagtttatcccgaaatgcgaaaggtaaagatacggcatcatcaagatataggtgatattatttatgaccggctaatattggctatgggagctagtcaaacatgggaatggggaacggaagaacttcaagactatctaattcgctcaaaaacgctatctcaagcacaagctagtctagagaaattgacaaatgcaaaaacagttgcagtgattggagcaggacagattggtttggaaagcttggatgcccttagccagttggatttgaatttgcatgtgtttgaggcgcaagattcactccttgcaaagtacgttgatgaggatatgattgcgccgattcgtcaagagatgaaaaaaagaggaatccaacttcatttatccgaaacagtcaatcagataacgattgatactcaggaagaacagctggtttgtcatacagtcacaggtaattatccagctgatttagtcttgccatccaccaatttgacgcccaatattcagctagtgaaagacaggctaaaagtgattgcagaagggactgtatgggtggatgagtttcttgaaacaagtcaagagaatatttttgctgtaggtgatttggtcagtctcccagtagattattttggacaggcatatcttccgatgattcatcatgcgattatgacagggaggatggctgctcgaaatttgcaaaagaggattgctcctattaagagagcccagcggattgtttctagtcatgtatttggctattatataactagccttggcttgaccgagagtgaggcgagcttgtggttggagagtaaatcgattcggattagaaggtcgtatagccagtgggaaccaactttagtagatttcaagctgattgtcgaagaaacgagtgggcgcatcataggggggcaactcgtttctactgcagattatattgaacagatggatgtactgtctctagcgatttcaaaggatttgaccgtctttgacttggtagaacattcttggctctgtcttcctggaaatactcctctggtccccttcatcgtagaggccgctcaagagtatattcggcaattttatcaggttgatggggagggtgtctatgcggattgattccttattggaaaagcgtgagctcgccatttatcagcttctcctctacttagaagataggaaagaggcgccatcgctaaaggatatttgtcactatttagaattgtcaaaattaactctttttcgctatattgtatctttcaatgaagaagcagaagtaaccgacttgggactctcttttcaactcgaagatgaaaaggtctttttgaagaaaaaggccagtttgagtcttcatcgtatcctagactatctctgtcaaaccagtaccaaatatcaaattattgtttatttatctgataaggaagaggtttctattcaacagctggctcaagaattgctgataagcgaagcgactctgaatcgccatcttgcctctttgaaccagatattggcagaatttggtattggaatcaaaagtggtcgtctaaaaggtagtgagcttcaaatacggtactttttacatcaaatgttgagtttgactactacgagagcggaattacaagaagagtttatgctagggaaaatagaggccttattgccggttttcgaacgcttctatcaatcgccgctaaatcccaagcaagcccatcgtctgttgttgtggttaatgatttcacagcaacgctctcgattgcgacagctagattttaagcacctttacaaattgatggaaccctatcaagaacataagttttaccgacgtttgagaaagatgtattttacactaagtcagcaacaatccacctctttccaagaaggggaaattatggcgttgtttgctttcctgtttagccattttattttagtgccgcatcaattagagcaggttcttggtttcggtggaccgattatggaagctacctctttggctcttcagaaattacggttatattttgagggaaatttaccagtctcagaagaagcgctctatcatttgaaccaaatcatgagccagctatatttcttttattcttccgttgaactggaagaggtagaagcttctagtttctattcagaagcagaagacttgctaaaagacgtctataaatcagtttttcatagaaaagtcgataaaaaaataaggaactcttatctgacaaatattgcggatttgtatatttattttggtcaggtccagcctatacaggtcaaggttgcttttgcttcttccctacatgaggttctatcctatcctctcttgttgcaactaagggagaagttagaaggcaatcgtcaggttcttattgagccctatcaagcaggatatgactatgatttgattattacagattacctcgaaaatacaagcattccagtttattgcctaggaaatcgattgaaaatccaagatatcgtacaattaaaggcatggatacaggatatatatcatcaaaagtcctgtcaatcagagattatggcgaccaaaacttcttttcctatcgagcatcgctagatgatgtcagatagtctttgtgaaaaatgtaagtgcatttaaccttgaaaaatttattttataaactctgataacagttgatagaatcatctttctagccactgcttatcagatttttttatttttttgaaaaaaatgataggaaaaattcacaagaatgggttagaatagaattaccaagaaaatggaagcgttttcaaaaaaagataaacaaacaggagggagacctatgtctactgaaaaatatatcatggccattgaccaaggaactacaagttcacgtgccattatcttcaataaaaaaggtgaaaaggttggcagttaccaaaaagagtttacgcaaattttccctaaaccaggttgggttgaacacaacgccaatgaaatttggaattctgttcagtctgtgattgcagggtcctttatcgaaagcggtgttcgtcctgatcagattgaaggaattggtattaccaaccagcgtgaaacaaccgttgtctgggataaggaaacaggtcttccaatctacaatgccgttgtctggcaatctcgtcaaacagctcatattgctgaccagctgaaggcggatggtcatgcagatatgattcatcaaaagacaggtctagtagtcgacgcctacttctcagcaaccaaagttcgttggattttagatcaagtccctggagcgcaggaacgtgctgaaaaaggtgagattctctttggaaccattgatacttggttggtttggaaattgactgatgggaaatgccatgtgacggattattcaaacgcagctcgtaccatgctctacaacattgaagagttgaaatgggatgatgaaattttatctcttctcaatattccaaaagccatgctgccagaagttcgttcaaactctgaagtttacggcacaacagctccattccatttctatggcgcagaagtgccaatctctggcatggcaggtgaccaacaggctgccttatttggacaattagcatttgagccaggtatggtgaaaaatacttacggaaccggttccttcatcgtgatgaatacaggtgaagagatgcagttgtcacagaacaaccttctcacaacaattggctatggtatcggtggcaaagtctattatgcgcttgaaggatctatctttatcgctggttcggcggttcaatggctccgtgacagcatgcgaatggtgactacatcacctgagtcagaagagcttgctcgtaagtctaccagcaatgatgaagtctatgttgttccagcctttacaggacttggtgctccgtattggaactcagatgcgcgtggctcagtctttggtctcactcgtggtacgactaaagaagacttcgtcaaagcaactcttcaatccattgcctaccaagttcgagatgttattgacaccatgcaattggatacaggtattgatatttctgtcttgaaggttgacggtggtgcagcaatgaacagcctcctcatgcaattccaagcagatattttgggtattgaaatcgcacgcgctcaaaaccttgaaactacagctcttggagcagcattcttagcaggtttagcagttggtttctggaaagatttggatgaattgaaagaactcaacgctgtcggccaatccttccaaccaaccatgaacgaagctcgtaaagaacaactttacaagggatggaaaaaagctgtcgcagcaactcaactatttgcagaagtggatgaagagcaataaaggacttgttagctaggggaaagaagaatttctgcttgctagacagtcctattcgaaagttaggaagtgaatcgtatggaattttcaaaagaaacaagacgcttagctattgagcgaatgcaggatcgtcaacttgacctcctcattatcgggggtggtattacaggtgcaggtgtggctttgcaggcagcagcaagcggtatggaaacagccttgattgaaatgcaggactttgcagaaggaacttccagtcgctcaaccaaattggtccacggtggtcttcgctacctcaaacaatttgacgtggaagtggtatccgataccgtatctgaacgtgctgtagtacaaaatatcgccccacatattccaaagccagacccaatgcttttaccagtctatgatgagccaggttctaccttcagcctcttccgtttgaaagtggccatggacttgtatgatctcttggctggcgtcaataataccgatatggccaataaggtcttgacaagagaagaagtacttgaacgcgaaccaaacttgaagcaagaaggattgattggtggcggtgtctatcttgatttccgcaacaatgatgctcgtttggttattgaaaatatcaaacgtgcagccaaggatggtgccttgattgccagccgtgccaaagctgagaaattcatcaaagatgatgctggaaaagttgtcggtatcgtcgctcgtgatttgctgacagaccgcacctttgaaatccgtgcgcgtttggtcatcaatacaacaggaccatggagtgatgaagtgcgtaatctgggtggagaaggttcaggcgttctccagatgcgtccgaccaagggtgtgcacctagttgtcgatagctctcgcttgtctgtaccacagccgacttactttgatactggccatgcggatggtcgaatggtctttgtccttccgcgtgaaaataaaacctattttggtacgactgatacagactatactggtgatttggcaaatccaatggtaacccaagaagatgttgactacctgcttgatattgtcaacaatcgcttcccagaagcaaacttgaccctggatgacattgagagtggttgggcaggtcttcgtcccctcttgtctggaaatggtgcttctgactacaatggtggaaacaacggtaagctcagcgatgacagctttaatagcttgattgaaacggtcaaaggttatatgaacaatgaaaagacacgtgacgatgtggaacatgatttgacccatctggaaggcagcgtttctgaaaaacacttggatccttcagctgtatcacgtggctctgcccttgaccgtgatgacaatggtttgctgactcttgctggtggtaagattactgacttccgtaagatagcggaaggtgcaattgaaaaagtggcagacattctcaaagaagaacatggtcgcagcttcaaactcatcaattctaagacctatccagtctctggtggtgaattgaaccctgcaaacgtagcagaagaaattgaacatcttgctcaactaggtgtgaagaaaggtctcctttatgatgacgccctttacttggcaaacttgtacggttcaaatgctccaaaagtctttgtattaaaccataaagtagaagccgtttctggcttgaacaagcgtgatttgctttcccttcactatgctatgaaggaagagatgaccttgactgcagttgactatcttcttcgtcgtaccaactacatgctctttatgcgtgagcagttggatgcagttgcgcttgaaatcattaaggaaatggcagcttattatgcttggtcagaggaagaagttgctcaacagaaacaattgttggcagatacacttgttaagaatgatttgacctatttgaaagaaaaatagaaagaggtgcatgatgacaaatgaattaatcggtgaagtgttgggaaccaccttacttgtcttactaggtaatggtgtggtagcaggagtagtactagataagagtaaggccaaggatgctggttggattgtaatcacaattggttggggtctagcagtagccatggcagcttttgtgagtggtttattgggaactgcccacctcaacccagctgtatcaattgcaatggcctttgcaggaaatctcccatgggcttctgtagtcccttacatccttgctcaatttatcggagcctttatcggaagtatcttggtctacctcatgtacaaagatcactacgatgcaacagaagacactggtgctgtgttggcaactttctctactggacctgccatccgcaaccttgtttctaatacaattagcgaagcaatcggaacctttgttttggtcttgggattactggctttcggtcagtatgattttccaacagggattggcactttaatcgtcggtggtttgattgtctcactcggagtttctcttggtggtccaacaggatatgccctaaaccctgcgcgtgatcttggtcctcgtatcatgcatgccatccttccattgaagcacaagggagattcggattggggctatgcatgggtaccagtagttggtccaatcatcggaggcttgcttgcggctctcctttatggtctcattttttaaaaaatatccttctctaatcagcaatggttagggaagttttttattacttggctgtcaatcgtgagcaaaagatttttatttatcaataattagtgataaaatatgtctatcaacatcagtgaggtcatcttatgaacaatacaggtattcatcacatttcaagcttggtaggaaacatacaccaagcctatcatttttatcatcatattctcggcttaaaattgaccttgaaaactgtcaatcaagaagattcaagcatgtatcatctctttttcggtgatgaagagggccgctatggaacggaatttaccatttttgatatgcctaaccatcccaatcatcgaaacggaaccaatcgtttggaaagaactgtttttctggtaaaaaattttgaggcattagaattctggcagaaaagactgacagagtttgaagtggagaatgaaggaattcaggcttttggaaatgggcatattctgaatttccaagatgaagatggccagttgcttggcttgacctatcataacgctatcggagaaatgtttccgtataaaatagatgaaattccgtcggaatacgctattcttggcattgccagtcttcacatgcgaatacgtgaagaaaaggcattactaagtttgctgacagaaaccttcggatttgttgaggaaagtcgatttgtctttgaggataagatagtgatttctcttctctttgataacaccttccaacatcgactttatttgatacttgaccaagagtcgccaatcagcgttatgggagtcggggccattcatcatatcgcatttggtgtcttagatgagtccgacttggaagacctgattagtcgcttaaatctcatcaatcgtccacattctggtatcattaatcgagatttcattcattccttgtacttccgagcgccaaattaccttatgtttgaggtggcaaccatgactggtgagcgcgaatcggaaatgccagctcagaatgaagagttggatcaggtagacctatttttgccaagtttctttgaagaggatagacaggaaatcgaaaaaaatctctcccaacgttattaggagaaatgaagtatggattatcgctttatcaaagggaccagtcccagtcttttggtctttttccacggcacaggtggcaacaaggaatccatgctctttcttcgctaacagctggatccagaagcttttgtcctttccttagatggaagttggggtcaaggcagggaaaggcgtttctttgcacctctcattgacggtcagctggatcttgtcgatgttgaaatgcgcttgtcggcttttctggatttttggcaggacttggacatccgagattatcgtcagattactttcgtaggtttttcaaacggtgctaactttatcatgggcttgttggccaagcagtcaaacctggcggacaattatatcttgctccacccttcggccttagattacgcttttcctatggaaaatagcagagcagagattttatttacactggggcagaatgaccaactcgtcgaccaagtcgctcttgaacatcttgtagatgactggcaagcgtcagcttttcccagagccaacctagttcgttttgacaagggacattttttaagtcaggatgaattgacctacgtgggaaattggtatcaagaaagaatagacaaaaagacctgaacaagttcaagtcttttatgtgtcttagattagtgtttccaatttatccaccaatgaaccaacataggcaatggtttctttgagtggttggtcagttgaaacgtcaacacctgcgtgcttagcaaggtcttgggcagaaagacttgcaccgagtgacaaggtttccaaccatttttcaacaacttcttcaggatgttcttccaattgtttcgccatagccgtaccgatggtcaaaccagctgagtaggtatatggatacaaaccaatgtagtagtgtggttgacgcatccagataagacctgcatcgtcaccgatttcaaagtcttcaccccagaattccttgatgacatccaacttgatttggcagagaatatcaccgttgaggtattcttcattgtccaaacgagtgtagacttcacgttggaaggctgcttcaagcaagtgagtgaccatgttgtggaagtaagtacggctgatcaactcgctaatcaagtaagcctggaagccagggtcttggttgtttttcaaaagggtgttacatgtcaagacttcatttgcagtagaaggcgcctcgatgaagtagagggatggatcgtagctaaggacactttgtttcttagccaattggaaatgaccagcatgtcccaattcgtgagccaataccaagacctcgttcatcaagcctgtccatgaaagtaggatgtaagatggtccatcgtaaagagtagcacagaagccaccagtagccttaccttcgttttgagcaaagtcaatccaacgctcatcaaatgattgttcaatcattttcacataatcttcaccaagaatgcccaggcagtcaatcaagaattgtttggattcttcaggtgtgatgcgttggttgtattcagatggtagactgattttcaagtcagcatgtgtgatcttgtccaatccatgagccttagcaaccaattttacatagcgacgcatgtgaggagccaattctttcatgatgacatcaatctgacggtcgaagagatcacgagagacattttgactatgcaagaggaagtcaatcgtattgtcaaatccacgcaagcgagcttcgatttgctcattcttgatatgagacaaataagttgctgcagttgtattcttgtattttttcaaggttgaatagaaaccagcagctgaattgcgacggatttcggtatcatggctgagctcataatcattttcaaagagcacatagctattgccgagcgtttcgccatttgcctcgaagttttcaaatgtcatatcttcaaacttggtcacaccgtagttgttatagggctgaccaaatgttggtgcaaaatttgataaaagttcttcttgaagtgggtgcagttgatgcggcttgtcacggagaatagcatcaaagaatgcagcccattgtggttgttcttcttttaattcaagtagaaaggcttcatctaattgaccaagttctgaatagaggaaatctcgttgaggacgtgccttggcagaaacgaggtcgtattcgttggccaggctcgccaattcagtattcatcttatcgacttccaaaggaaggaaggcatagtgggaaagtctgctatcaagaataacgattttttcgtattctgttaaggcggaaacgatggtatccttatcagttagctttcctttgtaattcgattcgaaagctgtcacttgcttagcgtaggctgccaaattttctttgtagttatcaggggtcggaaatagaatgtccgtatcccaagttaattgcacatcaatttcttgacgtttaggcattgcatttgtcatgattttctccttatttcattttaataggtccattatatcatactaaagggctttcagcgaaaataagccaaggcaaaatttatgaaaaagaatacttgacaaaatacacaaaaacctagataatgtaagtatgaaagggtttactgaaaaccagaaaggagcttttatgcaagtcattaaacgtagtggagagattgttgaatttgatccagataaaatctaccaagccatcattaaagctgcacagacagtctatgtcattgatgaaacttggcggaaaaatcttgctcaggtcacaaagaaagtagtgcttgacttggaagaagctcatacagagcgaccaacgattagcatggttcagtcgcaagttgaacatcgtcttttagatgcagggtatatttctattgctgagcattacatttcctatcgcttgcaacgtgatttagaacgtaacggctatggcgataagattattgtacatctgcgttttgaacaagtacgttaagagaaacctagagaaatctaggtttttgcttttatatatctttacattgtttaaagaaaatagcatttcaaaaactttttgaaaaaaatgtgatattctgagcatattttttgaaatcggtaacatttatattgtataatatagttcgtaaaaaaatatattttcgaaagtgagattttacattatggctaaaatcgttgttgtcggtgctaaccatgctggtactgccgcaatcaaaactatgttgacaaattatggtcaagaaaatgaaatcgttgtatttgaccaaaactcaaatatttcattcttgggttgtggtatggctttgtggatcggtgagcaaattggcggtcctgaaggacttttctactcaaacaaagaagagttggagagcttgggtgcgacagtatacatggagtcacctgttacaaacattgactatgatgccaaaacagttacagcgcttgtaaatggtcaagaacatgttgaatcatttgaaaaacttcttttcgcaactggttcacaacctatcttaccaccaatcaaaggagctgaaatcaaagaaggttcgcttgaatttgaagcaactcttgaaaacttgcaatttgttaaattgtaccaaaactcagcagatgttattgaaaaattgaaaaacaaagacatcaaccgcgtcgcagttgttggtgctggttacatcggtgttgagcttgcggaagcattccaacgtaaaggtaaagaagtagtacttattgatgttgtggatacatgtttggctgggtactatgaccgtgacttgtcagaccttatggctaaaaacttggaagagcatggtatcaaacttgccttcggcgaaactgttaaagaagttgctggtaatggtaaagttgagaaaatcatcactgacaagaacgaatacgatgttgacatggttatcttggctgttggtttccgtccaaacactgcgcttgcaggtgaaggaatcgagcgcttccgtaatggtgccttccttgtaaacaaacgtcaagaaacttctatcccaggcgtttacgctatcggtgactgtgcaacaatctacgacaacgctactggcgatacaagctacatcgctttggcttcaaatgcagtacgtactggtatcgtagcagctcacaacatctgtggcactgaccttgaaggtatcggtgtacaaggttctaacggtatctctatctacggtcttaaccttgtatcaacaggtttgacacttgaaaaagctactcgtcttggtttgaacgctgctgttactgaagtaacagacaaccaaaaaccagaattcatggagcacggcaacttccctgtcactatcaagattgtttacgataaagattcacgtcgtatccttggtgcgcaaatggctgctcgtgaagacatctcattgggtatccacctcttctcattggcaatccaagaaggtgtaacaatcgaaaaattggccttgacagacttgttcttcttgccacacttcaacaaaccatacaactacatcacagtagctgccttgggtgctgaataattaattgaatacaaaagctcagagatgactctgggctttttttgcttgccatctatcacattgaactgtctatcgagagattttttggtataatggagagaatgattataacgaacctgtattcacagtgtagtacttccatctaagcctagtttttcagctattcatcgtttgtttttcaaaaaatacagtcggtattccttcaaaaaactgccttgattagcgaaaaactatctcttatttaaaagcactccacttgtaatacatgttctaagaaagtatgagaaaatgaacccattattaaacggaatgaatgacagacaggcagaagcggtacagacgacggaaggtccgcttttgattatggcaggggctggttcgggtaagacgcgagtcctgacccaccgtatcgcttatttgattgatgaaaaaatggtcaatccttggaatatcctagccattacctttaccaacaaggcggcacgggagatgaaggagcgggcctatgccctcaatcctgccacgcaagcctgtttgatagctaccttccactccatgtgtgtgcggattttgcgtcgggatgctgaccatatcggttacaatcgcaattttacgattgtcgatccaggtgagcaacgcagtctcatgaaacggattttaaaaaatctcaatctagatccgaaaaagtggagtgaacgttctatcctgggcaccatttccaatgccaaaaacgacttgattgatgacaaggcatttgaagcgcaggcaggcgacctatacacgcagattgttgctaaatgctacacggcttatcaaaaggaactaagacagtcagaggccgttgactttgatgatttgattatgttgacgctccgcctttttgaccaaaatccagaggtcctgacctattaccagcagaaattccagtatatccatgtcgatgagtatcaggataccaaccatgcccagtaccaattagtcaagctcctggcatcacgtttcaagaatatctgcgtggtcggagatgcggaccagtctatctatggttggcgtggtgcggatatgcaaaatatcctggactttgaaaaggactatccagagagcaaggttgtgcttttggaggaaaactatcgttcgaccaagaacgtcttgcaggctgccaatgaggtcatcgaaaacaaccgcaatcgacgtcccaaaaaactctggacacagaatgcccaaggggatttgattacttactatcgtgccagagatgagaatgacgaggcgatttttgtcgcagggcagattgaccagttgcaccgagaaggcaaggcttataaggattttacagttctctaccgtaccaatgcccaatcacgtaccattgaagaagccctgctcaaatctaatatcccttataccatggttggaggaaccaagttctacagccgtaaggaaatccgggatgtgatttcttatttgaatatcattgcaaatccatcggataatatctcctatgaacgcattgtcaatgagcccaaacgtggcgttggacctggtacggttgacaaactccgtgattttgcgaccagccacagtatgtccttgctagaagcttctcaggatattatgttgtcaccagtcaagggcaaggcagcgcaggcagtctttgacctagccaatctcctctataatcttcgcaatcaattagacaacttgacggttacccaagtagtcgaggcagtattgaaccaaacaggctacatcgatgcccttgcagcacaaaataccctggaagcaaatgcccgcattgaaaacatccaggaattcctttctgttaccaaaaactttgatgaaaaggatgttgaggaagaagagacaggtctagataaattaacacgcttcctgcttgatttggccctgattgctgacacagatgatggcgatacagaatcttcagaagtgactcttatgaccctccacgcagccaaaggtctggaatttccagttgtcttcttgattggtatggaggaaaatgtcttcccacttagtcgtgcagcagaagaagaggacgaattggaggaagaacgtcgtttggcatacgtaggcatcacccgtgctgagcagactctctacctgaccaatgccaattctcgactccttttcggtcgcaccaactacaaccaaccaagccgctttattcgagaaatttccagtgacttgcttgattatcaaggcctcgctcgtccagctaatactagctttaaggcttcttatgtcaatggcagagcgacacagtttggacaaggcatgagcttgcaacaagccctacaaagtcgaaaagcatccgtacaaccatctgccaagctcggaggtagtatgcccttcgcatcaagcaaccaatcgtcaagctcaggcaccaactggtcagttggtgacatcgcagtccataagaaatggggccgcggaacagtccttgaagtatcaggttcaggcagcaatcaagaactcaaaatcaatttccctgatatgggactcaaaaaagtcttggcaagcttagcgccgataagtaaagaagattaaatttagttaaaaaataattgcagtaagctcgaaaatatgataaagtatttttgtaaaattgaatagaacatttggggtgccaagaggctgagattatacccatcgaacctgatgcagttaggactgccgaagggaaatgtgtatcaacaaattttgttgacaagtactatatttgtattctagtatagaatactgtatttactggtcatcaatcatcgtaggtgtaactccatttgataaaccatcagatggagttttttctattgtcgaatgaagagttctcagaaatacggaattgagtgcaggtagctcgaccagcctagaggctatactacgatggaaataagatatgcgcaataagtcactttcgtagagttcgacaaggcgaaactgatgataaggctaatacaattaatagtattttcacaaatccccttagccccttcaatttacattttcaccgagaaaaagagaaaggagatatagatgaacaaaatggtcatttggtttgaccttgatggcgttatctttgattcctatggggtctgggatcaggtggttcaaggaattttgaaacatcacggggttgcttatacccagcagataagggaagaactttggcgtattccaatggaagatgtcaacgggtatttattgcaacttgtggagaattccttagatgagaatgaacttgaaaggcaaaaaatgaatcaactgcaatcactatatagagatatttccttgatggatggtgtgcatgaactcctatctacattgaaggcaaaaggtgcagtcatgtacgcagtcacttcaaactatctggagctggctgaactaggattgtcatcccatcatctttcaaactattttgtgaaactatttagcagtttgaatctgtttggaagcgataaaaatagggagttttaccaattcatcctacatcaggaacggatagatccagccaatatcgtaatggtcgaggataataagaacaatctttgtattggacatgagttaggaatagcgggagtttatatagaacatccaaattcccctttttctgatgagaatacaggtatagttagcatcaagcaattaagtgaattaataccaattttggaggatagaaaatgacatctttacatgtagcattatcaatagcaggaacagatccaacaggcggagcaggcattatggctgatttgaagagctttcaggctagatcagtttatggtatggcagtcgtgacgagtgtcgttgctcaaaataccaaaggggtgcaactaattcgtcatcttgatcaggaaattttagaagaacaattgaaaagtgtctttcaggacattgttccagatgcaataaaaactggaatgttagcacaagtcgagaccattgagcttgtcgcaagctatcttgcaaaacagaagtgtccatatgtcttggatcctgttatggtcgcaacgagtggagaccgtttgattgaagaggatgcaatcaaagcgctgaaaacaaaattactgccccttgctaccatcattacaccgaatctaccggaagcagaagttctagtcggtagaacactgaaaagtgaaaatgacatcatgaatgcgggccgttggattcggaaagaacttggggtaaaaaatgtggtcattaagggtggacatctggcaaaggcggcatctgactacttatttttagaagatggtgagattagtgtcatcagtgcagcacgcatttctacgaaccatacccatggtacaggttgtacctacgcggcagtcattactgcagagttggcgaaaggtcggacagtagcaaaagcagtcgaaactgccaaacgatttattacagaagcaattcagactgctctagaactggggcatggaaatggtcctgtcaatcataccacctacagaggagagtaactagatgtatttggaaaaattacgtagtcaaaatcccttgaccatttgtattacgaatgatgtagtcaaaaattttacagctaatggcttacttgctctcggtgcctcacctgcaatgagcgagtatccagaagatttggaggatctacttccctatacaaaggggttattgattaatacaggaaccttgaccaatgaaacttgggaactatacaaatctgccttggatattgctgagaaatatggtgtacctactgtcttagatcctgttgcggcaggtgctggtgcctatcgcaagaaagttaccttggatctgttacatcatcatactatttcactcgttcgtgggaatgcaggagaaattgcagccttgattggtgaaagtattgaaacgaaaggggtagattctgctcagattgacaatgtaggtgaacttgctctcagagccaaccaacaattaggaattcctgttgtgattacaggaaaaaaagatgctgtcgctgtgaatcatcaggttcggattttggaaaatggtagtgagttaatgccactagtgacagggacaggatgcctgctgggagcagttctggctgcctttattcacctggctgatgaggattcattattggattgtttggaagaggtcctatcggcttattcgatcgctggagaaatggcagagcagaaaacctcactaccaggaaccttccagattgagtttataaatagcctctatgcaatccaatcagaagaggttgaagaaaataaaaaggtcattcattatgaatagaaaaatgcttcaagtttactttatttgtggcacgtcagattgtccaaaaggcaaatttttggatgtactggaaaaggcattgcaggcaggaatcacttgttttcaatttcgtgaaaaaggtgagcaaggtttaacaggggctgataaactactgttggcaaaacaagttcaacacctgtgtcaccgctatcaggttccattaatcattaatgatgatgttgagttagcacgtgccattgatgctgatggaatacaccttggacaggaagatttgtcagtagtagaagcgagacagctcttcccagggaaaataattggactatcagttggaacaaaagaagaatacctcaattcgcctattgatctagttgattatatcggaagcggacctgtttttcctactctatctaaggatgatgctagcccagccattggaatggatggattaaagcaattaaggaaactcaattccgatattcccatggttgcgataggagggttatctgctaaagattgtaaggaagttctccaagcaggtgcagatggcatagctgttatctcagccatttcccatgctgaagacccctacaaagcaaccaagatattggtggatgggatgcaagcaatgattttaaaatttaatcaagtagaatctaataaacaaatactaaaaaatccctaatcaatttgggtcttttcatttgatattaaaacgaattcttagttgatattagtggcaagaaaaatagtttttctactttacaaaaatcaaaagccttaaaaatagcgcaattttattatgttatataaataagtgttaaatatttcagaaaatctgactacttcacaaaaaattaaatcatcttttgtaatggaatccgcatttagcaatacaaacattcatcattcgaaatgagtagaagttaagtaatacaaattagagtttaaaagctcttggaattaggaagattttatcaaaatttatttataaagtatggcttagaaatctggaacaaatcgtaaaacaagaagacatttgtccttaaaatgtttgtgtattatgacattggatatgtttttttgctattgaatcggacggaattcctttacttgcaaaaaagaaagcgttatcattgttgtggtaacaataaagaaaggagcgtgtatgattttgaaaatgcatctactattggatataatcgagatgaatccagatgtatattcattactaaagctttgcccatatgaaatcttgcgtaaaatacatgtcaagagattcgaagatggtgaatttgagttggagcaaggggagatctatcagtatatgtatattattgttgaggggagggtcaatgtttactcggaatcggaaaatgggaaaaaatattttctttgttgtagtcagtctggtgacttgattggagaaatggaaatatttcaacaagttccgtatattagttatgtgaaaggagttggtgatattatcgctttggaaatagataaagatacacttttgagttggatggcattagatcaaaactttagtagtttgtttattaagaagatttgtgaaaattcctatcgtatgtgtaatcgtatgaagcgcaatagtctatatgatcttagacagcgacttgcatactatttgctggagcaatttggaggaaaaaaattagcatcattacagtttaattcggaaagattgagtcaagagatggcggttacccaacggagtatcaatcgattgttaaaagaatttaaagaaaagcaaatcatcgatttaggtcatggtaagattcaactattggaccaccaagctttaacgagtttactagattaggagaaagaaagatggtactacaaccacatattcgttgtgacatagaacaaggtgcaagatacgccatattgccgggcgatccacagagggtggacagagtagcagagtttttagatagtgtagaatttatagcattcaatcgtgaacacaaaacaatgcgtggaagctataagggggttccagtgttagttacctctacagggatggggggtgcttcaacaggaatcgcggtagaagagttggcacgtatcggtgtggaatgtatgattcggattggctcatgtggagcattgcaaccggagatgcagatgggagatttggtcattttgaatggggctgtacgtgatgaggggacttctagggcgtatgttgatccaatttttccggcggttccagaccctgatgttttatttgccttacgaggaactgctatgaaccaaggttttgcccatcacgttggaattgctagaagccatgatagtttttatattgataatgagttggaagttgatcatttttggtctaaaaaaggtgtattagctggagacatggaaagtgcagctttatttactattggtagcctacgtgggattaaaacgggctccattttaaatacagtggcactatatgatggtgaattgaaagatgagatcaaccaatatgtgtctggcgaaaatcgtgtgacacaaggtgaaaaaaatgaaattcttacgacattggaagcgattgtgatgctagaagaacaaaggaaaggatagaatcatgaattggagaaataataatccattatcattgaagtttaatactgcagctttagtgttgattccggcaggggttgggattaattatattggtaaattgattgcgggggttctcaaattaccactttggttagattcgattggaacttgtttatcggcttgtttggctggtccaattgtaggtgctgttgtgggaattatgaataatttaatttatggattaacggtggatccgatttctacagtttatgccttaaccaatgcagccctaggaattgcagtcggtttattggcttattacggtagtatgaagaacatcaggggtgccttatttacaggaattgttgctggatttgcagcagtcttggtatcaacgccattgaatatgatcttttggggtggtacaaccggaaatttatggggagacttggtttatgcaggtctattagctcaaaaattcccagtttggtttgcatcgtttatggatgaaatagtggtagatattccagataaaatagtcgtattattacttgtgctaagcttgtataagagtttaccaaagagtctactatcgctttaccaaagtaatagtgtgattaagaacctagattaaggaggtctccatgaaaacgatgagtttgtttgaagacaagaattcatttttgaataatttgtctccgttaactaagatattgtatgtgcttgcgaccattctgataccgattattgcaggtgatttagctgtatttagcattacaattcttttaagtgtcgttttgttagcacattctaaagtgttaaggcagaccttacccattctgagtgtatctgggtttgttattttaacggtaggaattattcaaggattgtttagaagtggtaatgtcacgcctgtttttcaattaggtccagtcattttttataaggaaggcttgatatttgcagctgagattgctttaaatgtatgtaatattattttagctttctgtgttctgattttaacgacaaaatcgtcggacatgattgaagaattagttagaaaaggcttctcacctcgaatgggatatgtgtttgtctccttgttccaattaatccctcagatgacgagccgaatggcaacaattacggatgcacaaagaagtcgtgggatggaaacagaaggttcgatgttggttcggctaaaagcttttttgccattggtctctcctgtaattatgagttcttttattgatacgagagaacgcgcaattgccttagaggttcgaggatttaattcaaaatctaaaaagacatttatcaatccaccgattcgttcgcaatttgatcgattgattcaaattttctgcatttttggagttgtgctagcaattgtctggagggttctataatggcacatattaaaattgaaaatctaaaataccaatatccctttgctgaaaagttggctctagacggcatcacgtgtgagattcgtccaggtgaattcattggggtaattggtcgaaatggttctggaaaatcgacattctgtcaatcattaacaggacttgttccgaatttttaccgtggttcgtatggaggaaaggtatggattgatcaatccgaagtgaagagggtagaggttgatgacttgtgccaaaaagtcggaagcgtttttcaaaatccatttaatcaaattacaggttctaaggcgactgtgtatgaagaaattgctttcggtttggagaatttcggagtcccaaaagaagaaatggaagttcgaattgaggaaagtttacgtttgttggacattgaagagtaccgtgatcgagctccgtttgacttgtcaggaggacaaatgcaacgaatggcaattgctagcattatggcgatgaaaccagaggtcattattttagatgagccaacttctcaactcgatccacaaggtagtgaggcagttttcaaagctattcagtctttaagtaagcaaggcatcactgtaattatggtggaacataaggttgaaaaaatcgcagcttacagtgaccgggtaatgttgcttgatcagggaaaactaattgccatggatacaccacaagccgtgttttctcgaccagatctagaaaagtatggagttgtagcacctacctttactagaatatgcaagcagttaggcatgaagctaccaggaagttcctattatcctgtgacacttgaggaagctagtcagttgttggcaaagaatagggggggaaatgtatgaatcaaattagtattagtaacttagaattttcctatcatccggataaaaaaatattaaaagggttgaatattattttagatgagcgttcgacggcgattattggacaaaatggtgctggaaagactacatttgtaaagttactgaaaggccttattcgtccgacggctggtaaaattatgttaaatggacaagatttaagcgaacaatctgtcgctaaaattgctaaaagtattggactcatttttcaaaatccagatgaccaaatttttaaacatacggtattagatgaaattatgtttggaccattgcaaatgggcatgactcattctcaagcagaacaggcagctagaaaaactatgtccttgctgggcttagatggatttgacaaggtaaatccctacgacttaggattatccgatagaaaaatggtgtcaatcgctgcaatagttgctatggatacacaggttgtgatttttgatgaaccaacgattgctcaagatgatgcaggaaaaaaacagattcaatcggtgatacaattgttgagagaacaaggaaaaatagttatttccattttgcatgatatggacttcgtagcagaaacgtttgaacgtgcccttgtctttgcacaaggagaagttttgttagatggaagtgttcgagaggttttttcacagaaagatgtccttgaaaaagcctatctatctcagccaaccacgatgcaattatgtcaagcactaggctatgatgacgtttttctcactcccgaagagttcatagcttacaaacaggagtgatgtacttaaattacaatctaggagattcctggtaaccgcttggtttttataatgttattctatactgcttcctaattattgaacgatattagtctaattctaagtttgtgagagattgcagattgaggtagttctgtttctattcttttaatctttttgaagcggacgaggttctcctttctgtatcactataaatttgtaaattaaaaatttgaatcagaaaattttataattttacaaatgtatatatttttccatttaatttagaagacttgatttgtggatagagggtaaatatttcacattgaaactttgatggaaaattatagcctttgtattttttagtatgatataattattactataaagatctagttgaattcaaaaactttatcaataagatgtctatacttgaatacttagttgtgctatctatcaagataatacacactgatataagggctatctgccgataaaatacagaaagccaagatatatctgaggctaagcggtttaaaaaggagcggttcttaaaaatgaattttacgatgatcactatagattagaaacgaattgatttcactcaaatagagggtgtttttagagaggaaaatcccaaaattgcactacaaacatttattattcgatcttgaccatactcttcttgattttagccgtggagaagaagtagccttaacccagtttttgacagctatggaggttgaagatattcaagcttttaaagaagtttatcgaccgctcaaccagagcatgtggaaggatttggaaaaagggaacattacaaagaaagagctaataaacacccgcttttcacggacctttgcccactttggtcggcaagttgatggaagggagatggccttgcgctaccaagagtttattgggcggcagggacaaatttttacaggtgcagataagcttttgcaggaattgacacaccgaggctaccagatttatgcagcgaccaacggcgtgacctatatacaggaaaatcgcttgcttcactcaccgattcaatcgtattttaaagaagtatttatttctgagcagatggggacgcaaaagcctgcgactgatttttatgaaaaaatagcagagcagattgcaggttttcaatttgcccaagccttaatgattggagacagtttgacagcagatattcaaggcggaaataatgctggtatggatactgtttggtataatccgactcacatgataaataatagtaaggcagttccaacctataccattcatagctatcaagaattattagatttgttataagatattttaagaaacttataaggattttagtatataattatacagaaagaatatatacaaaaatataaggaggaaaaagtgaaaagattactgagacgcattcgtccaacaaagcccctaaaagaactcacttggatagatttgattattatcacaacgattttatgtggtaatgctatttatacctcaaccatgcaatggatagcatcattttctgcaacagaaaccgttgaaacaggagttctgtcgtttagtccagccgataattggtgggctctagccaatcaaggaaaattattcctgtttgccctggtgtatttattgattcggaattatgatttcaagcagctaaaagtaaaattagaatggaccgttctactctggggaccactgattttcattggtgcgggcctgattagcgatttgacatttacagctttttcatatattccaggtctgtctggtgggtataatttcctcggatacttgccttactatgactggaatatcatgacagtgctcaaccgtttcctagccgttgactacagcacagttatctattccttgtttaatggcttctatgaagagttctttttcttaggattattgttgagcacagataagaaaaagcgttcgctggtcttactcttttcaacaattgtccgtatatctttccatacctatcaaggaatggtatctgctcttgttattggtgtagccttcggccttttctattactacatgtacacaaggaaaaatgacaatttattgccatatttcttaggacatgctcttgcggatatggttggtacaagtttcttctcattatttattgcagggtaaacaatgagaagaacggacatcaagctaatcggataaaatttctttctccctacagctgacaaacggatgatgatacgtagtttctattaacttggtatcatcacccgttttattgtgctgatatatttaatctattcagtcaaatttcgattgctttatcatattttttatcccatatttttttgaattaacggtttatttatgttaaaatgtatttttatacatcaaaaaggagtatagatatgaaacaaataaagaatcgtttaaaaaaacatatgttttggattggactcatttcgttggtattgatgctcgttgataatgtcctattttgttattttaatattgaatgtagtcgtaccttaaaccaaatcgagcagacgatttgtatcatccttagcattcttgtatttttaggagtgctaaataataaaccggatgtgaaggtagaagacatcatgaaaaacggtatgtcatctaaaaatcaaaaataatgtttgtttagaaactactgatgaggtatctagttgtacttacagttcagtatctctagctaagatggatttttcaaaatatagtcagtatctcctaaaaaactattttgtatataaatcactttacttgtgaatacgactatttaacatcatatatgtccaccagtcgaaaggctggtgtttctatttatgacatgtatgttatcaggaatgccactatttgaaaggaaaagaatcgagagaaattcaatgaatactaaaaatatcaatagtagttaaaatcataagccgtcattagacggggtcttatgattgtgctacaatagacataattataagagaacggggtgatgataatgaaacgtactattctattatgcttgccgacaatactgttactagcagcatgtcatcaaaatataaatcaggccaatactacaaaaaattcgtcaacagttgtttcgactacttcaagtcagtctgcttcaacaacttcggagcagtcaacaagcagctctacatcggcggaaacgaatcaagaagtaacaagtacagagactcaggtaaattttaacggttcctattatagtgtacaaggaaaatatggcgaagtgattattgtaaataaaaagcatccgcttgcagctgattatgcaccgggcgaaaatcctgaagccttagcagcttttcaacgattaatagcagatatgcaggcgctaggatttggtatctccaataactatagtggatttcgttcctatgaaactcagtcaagtctctaccagtcttatgtaaatcaggaaggacaagcagcggcagataggtattctgcaagagctggatatagtgaacatcagacaggattagcctttgatttattggatacaagtggtaatttattagaagagcctaatgcttctcagtggttggctacgaatgcacatctatatggctttgttgtccgctatcttccaggaaaagagtctagcacaggctatatggcagaatcctggcatgtgcgatatattggtcaagaagcgacagatatttacaattcaggcttgaccttggaagaatattttggtgtaccaggtggagactactaattttacatttagtcagaaataagtcgaaaaatttgtccgtataactaactcgtgatataataaaccatcataattttggaggtccatcatgcttaaagcaatggaagtatacttggttactaatggtaatggtttggaagccatcgagttttataaaaatgctcttggggcaacagtggagcaagtaaatctatttaaagatttcttaccagactgccctgctgaactagaaaattacgtaatgaatgcacagtttcgtttgaatggtcagcgttttatgttgtcagacaacaacccagaaatgccttatacagtaggtgacaatattacagttgcgcttatcacagacgatgctgagacagcgcaggaactatacagcaagttatccgtagatgcaactgctatcaatatggaacttcaagcagttccttggtctcctgcctatggtaatgtaacagacaagtttggtatctcttggcaaatcaatgctgaagtagaaggctacggtcaggaatattacgcagaaaactaaaatagattggacaaggccttgtccaatctattttagtttttgccaataagctttgtagatataaagttgaagagcagcagatagaacaaatagtaaggtcatcaaggctgagcttacataagctgcaccaatagtgccagctaatatgatgctgacaactagaataatggctccgagaaacattgttcctatgatcgatccagcaatcaaccattgacccgctccgcgaccaaataactggttactattttgccagttgagcatgaggagtcgctggtcacgccagtaataaatctgaccagttagcagggctgaaatgatgatgccgactgtaaagaagactgctagaatgagtttgactttcatgaaacctagagccaaagcaaagtaaagtagagttggtagtgcgaattgtaccgcagccaatacccagaatttttggatgataaattttttgaaactaataggaagcgttcgaatgaaatgataattttccttttccaatgacatggctactccgatgaaggttgtagaaccagcaaatagactgccaagcaagaatccagctaatagagcaataccaaagaaatcccattcaactgaacttagaccaccattctccgtgaaacggctaaaacttggaaaaagtgccacccccatgatgataggctgtatcatggtttggaccatgaggttgctatctttaagagtagataggtggtgtttcactaaagcctgattgagattgctaggaatcttggcagacttagcattattggtccgttttgtcgaagcattttcaatcgccaaaacttgattaaagtagttgggaatgacagttttaaacgcaaacgtaataagtccaaacatcaaaatgaaaggaagtccaaaatgaaggagtgtttctagtgatatagtatggctgaccaagtaatggaatccagcaaatataggtatgataggaaaatcaacaaagccaccggattcgagtgaaacggtctgctgggattgcaggaacatgagcgcagcaaaagccagcaaggaagaacctgtcatcaggattgtagaaatcaatgttttacgagggctttttgtcagaacttccccaacaaagtgcatgataatcagattgactaaattaactaaaatccagagaatcaaaaaggaaggaatggaagctaaggcgaggagcggaccgccaatttgccagtaagtgattagaagtaaagacagacacggcatgaggaagggtaggaccatcccttgtgcagagaggattttagcgaggaagacttcttgtggcttcaggggaagtgctaaatacaattttgtatccttactatcgtagaaaacggagaagaaacctgtaaaaccgtagacaatggcaataatggtaaagagcgctagttgcagagaaaagaaaccgatagactgactataatctactcccatgaaaaagacagagtagagaagtccgaaactcaaaaccataaatacttgttgcaagaggacacttttataggctgaaaaggaggcgtctttgcgcttactttgtttcttcttgacggaagctagaagttgagggttggaataaagaatattaatctttactagttcccaaatgatggatttactcatacttcctcacctgccttcacttgttggcgtccagctaattccaaatagatggtctccaaatctttatctggatactgtgatttgagttcatcaagacttcctacgaaaatgagttgcccttttcggagaatagcaatgcggtcacagagttgttcagccactgaaaggacgtgtgtagaaaatagaacggtgtgaccagattgagcatgttctttcatcatttgttttaggtcgaaagaggcctgaggatccagtccagttaggggttcatccaaaatccaaatatcagggttagggatcaatgcaccaataataatggttttctgacgcataccatgtgaaaaactgtcaataggctcatgttggcgcgctgtcatatcaaatagactagatagtttagcgatacggtcatcaactgtatccttttctacaccatagaccttgcccataaagtgccagtattcaaatgctgttaagtgtaggaagatgtctggcgaatctggaacataggctatccgttttttgacttcatcgcggttctcctctaggtttaaaccatcaacagagatagttccataactggcttcgattatcgaagtcagtagactgattgtcgttgtttttcctgccccattgtgaccaattaaaccgaaaatctcgccgctttcaattgtcaaatttaggtcatcaagtgcgattgtttcgccgtatgtttttgtgatatggtcaaattgtatcatagtaacctccttgttattcgtgaactaaaagtaggggcttgctaggtattccaagccttattccactgttcttcgaataatatatacaattaattacatttattatactgctgaattagtacaaaagcaatagtttctatcaatatttttgtagtatggatgcggatatattgcaagaagtcgagtgtaaaatggaatgcaataagctcgattatcagaaaatttgctataatagatctatgaacgatttgatcaagcataaattggagttactaccagatagccctggctgttacctccataaaaacaagtacggtaagattatctatgtgggcaaggccaaaaacctacgcaatcgggtgcggtcttattttcgtggtgcccatgataccaagacagaggctctagtggctgaaattgccgattttgaatttatcgtgacggattccaacatcgaggccctcttgctagaaatcaatctgattcaggaaaacaagccacgctataacatcatgctcaaggatgacaagtcttatcccttcatcaagattaccaaggaacgtcatccacggctgctcattactcggcagattaagaaggatggtggtcagtattttggtccctatccagatgtgggtgcggccaaccagaccctcaaactattggagcgcctctatcctttccgcaagtgtaaattgcctgagaacaagtattgtctttattatcatttggggcaatgtttggctcatggagacaatatgcccagcctgtctgactatgacaagatggccaaggaagtggcccagttcttgacaggtcatgatgataagattatcaaggaagtgcaggacaagatgaaggcagctgctggcaatttggaatttgaaaaggctgcggaataccgggatgtcctccaatccatttcaaccctgcggaccaagcaacgtgtgatggctcatgacttgcagaatcgagatgtctttggctactacgtagacaagggctggatgtgtgtgcaggttttctttgttcggcaggggaaactgattgagcggaatgtcaatctttttccatactataatgatgcgggcgaagactttttgacctacatcggtcagttttacagggaccagcaacatttgattccctcagaggtcttgataccgcaggatattgaccaagaagccgtagaagctctggtagataccaaggtcatcaagccccagcgtggcgagaagaagcaactcatcaatctggcaaccaagaatgcgcgtgtcagtctggagcagaagtttaatcttttggagaaaaatctggagaagacctacggtgcggtggagaatatcggtcagcttttggggattccgacgcctgtgcggattgaggctttcgataactccaatattatggggactagtcctgtgtcggctatggttgtctttgaaaatggggtgcctaataaaaaagaataccgcaagtacaagattaatacggttgagggaccggatgactatgcttccatgcgggaagttttgcagcggcggtacagtcgggtgctgcgggacggtttgacaccgcctgatttgattatcattgacggtggtcaggggcaggtcaatgtcgccaagcaggtcatcgagcaggagttgggtatgtccattcccattgcaggtttgcagaagaatgacaagcaccagacacacgaattgctctttggtaatccgctggaagtagttgagttgcctcgcaattcacaggaatttttcctcctgcatcggattcaagatgaggttcaccgctttgctattgagtttcatcgtcaggttcggtcaaaaaattccttctcatccaaattggacggcatagaaggcttgggaccaaaacgcaagcagactttgatgaagcatttcaagtctattggcagtatccagtcggccagtctacaagaaatcgcagaagcaggagtgccgtataaagtagcggaaaaggtcaaggaaagcctttcttcaaaggatgagatttgaaaacattcccataatgtgttagaataaactatcaatgactaaataaggagaaagtaatggcttttggtgaagaaaaacacaaaaaaacaacatttgagaaagtgactttagtaatcgttgtcgtgatggttgtagcgacattggctggcttgattttaccagctattaatgcattgatgaattaagaacctgtattcactgttcagcacttctatactaaggctagtttttaagcactcatcgttagtttttttcaaaatacagtcagtattttgaaaaaaccaccttgattggctaaaaacgatttcttatatataagcacttcgcttgtgaatacaggtctaaaacgcttttaagcgtttttttctaggaaagaatagggtaaattatgagtatgtttttagatactgccaagattaaggtcaaggcagggaaaggtggcgacgggatggtcgccttccgccgtgaaaagtatgtacctaatggcggtccttggggcggtgatggtggtcatggtggaaatgttgtcttcgttgtagatgaaggcttgcggaccttgatggacttccgttacaatcgtcgctttaaggctgatgatggtgaaaaagggatgaccaaaggtatgcacggtcgaggagcggaagatttaattgttcgtgtaccgcagggaacaactgtgcgtgacgctgatacaggtaaaatcattacagacctggttgagaatgggcaggaatttgtcattgcccacggtggtcgtggtggtcgtggaaatattcgttttgcgacacctaagaatccagcgcctgagatttctgaaaatggagaaccaggtgaggagcgcaatcttgaattagaattgaaagtgttggctgatgtaggccttgtaggtttcccatcagttggaaaatcaacgcttctcagtgttattacagcagctaaacctaaaattggtgcctaccattttacaaccattgtgccaaatttgggaatggttcggaccaagtctggtgagtcatttgcagtggctgatttgcctggcttgattgaaggtgctagtcaaggtgttggattgggaacgcaattcctacgtcatattgagcggacacgtgttatcttgcatgttttggatatgtcagcaagtgaaggtcgtgatccttacgaggactatgtagccatcaacaatgaattggaaacctataatcttcgtttaatggagcgccctcaaattattgttgccaacaagatggacatgccagaggcagaagaacatttggaagagttcaagaaaaaattggcaaccaactatgatgagtttgaagaattgccacagattttcccaatttctggtattgctcaccaaggtctggaaaatctactagaagctacagctgagttgcttgagaaaacgccagaattcttgctctacgacgaatcagatttccaagaagaagaggcttactatggctttaacccagatgaaccagaatttgcaatcagtcgtgcagacgatgcaagttggattctatctggtgacaagctggaaaagctcttcaccatgaccaacttcgatcgcgacgaatctgtcatgaaatttgctcgtcagttacgtggaatgggtgtcgatgaagccctccgtgcgcgtggtgccaaagacggcgacatcgtccgtattggcaagttcgaatttgagttcgttgattaacgtagcagtttgactgcaagttaacttgctagttaaactacgccaagtcctatgggatcttggctagctaccttactaacttcacccaaatggtggtatcaaccatttgggttccgtgtcgtaactttggaatcacatcaaaatcctaaaggacttgatgtgatacggtagccgctatggcggactacctaccaaccttactaattccgcacaggcagtggtatcgactgcctgtactccatatcgtaacctgtccggtaagttagtctagtatgaacttagaaattcgagagcagactatagctttacaaatttcgttcagttggtgacagtcgtttgtgagcaatcttaaaaaaaatagttggaggtctgtatgggtgataagccaatatccttcaaggataagtatggaaattttgtctcagcagccgatgtttggaatgctgaaaaattagaagaactctttaacaggctcaatcccaatcgcaaactccgtttggaacgtgagcgtttggcaagagagcaagaaaaggaataacgtcaaaatctgcttgttgtatcagaaaacaggcagatttttttaaaatttattgactatttattattggttatatgtataagaatacaagatatggagctaatatttttgcggtgtcggtaattttatagaaattctcaaaagtgaaatttcttaaaaaatatgtaaaaactatgaatatactggtttcttcttgaattgaagcgaattcataatgtttttttgaggaattttataatattacttggcatttaaagttatttgtagtataatacctcgaatgattgcgggagttttcaaggctttgatacaaagagtagaaaatttgtgtaattaaattaatatttatatgggggattttttatgcgtagatcaaataaaaaatcatttgactggtacggtacgaaacaacaattttcgattcgtaagtatcattttggggcagcaagcgttttgcttggtgtgtcgttagttttaggtgctggtgcacaggttgttaaggctgatgaaactgttgcttcatcagaaccaactattgccagtagtgtagcgcctgcttcaacagaagcggttgcagaagaagcagaaaaaacaaatgctgaaaatacgagtgcagtagctacgacttcaacagaagttgaaaaagcgaaagctgttcttgaacaggtaacatcagaatcaccacttttggctggtcttggtcaaaaagagttggctaaaactgaagatgcaactcttgcaaaagctatagaggatgctcaaacaaaacttgcagcagctaaggcaattttggctgactcagaagcaactgttgagcaagttgaagcgcaagtcgcagcggttaaagtagccaacgaggcgctagggaatgaattgcaaaaatacactgtagatggtctcttgacagcggctcttgatacagtagcacctgatacaactgcatcaacattgaaagttggtgatggcgaaggtacccttctagatagcactacaacagcaacgccttcaatggctgagccaaatggtgcagcaattgctccacatacacttcgaactcaagatggaattaaagcgacatcagagccaaattggtatacttttgaatcgtacgatttgtactcatataataaaaatatggctagctcaacttataaaggagctgaagttgatgcctacattcgttactctttggataatgattcgtcaacaactgctgttttagcagagttggtaagtaggacaactggtgatgtgttagagaaatatacgattgaaccgggcgagagtgttacgttttcacatccgacaaaagttaatgctaataatagcaatataactgtgacttatgatacctcattagcttctgctaatactcctggagcattgaaattctctgctaatgatgatgtttattcaacaattattgtacctgcttatcagattaatacaactcgttacgtcactgaaagtggcaaagttttggcaacctatggtcttcaaactattgcaggacaggtagttactccatcttctgttcgtgtatttactgggtatgattatgtggcaactacaactaaagccgttcaaggtccatatccaaagggaacggtataccttgctggtacggttcaaaaggatacagtacaatataaagttattcgtgaaattgtggagaacgaccaagcagttcttaaattctattatttagatcctacctataagggtgaagtagattggagaggaactgatacgactgggtttattgagttgcttacaacttccccaacaacctataaagttggtactatatacgattacaatattaattcaaaaattacagctccatttactattgatcctaccaagaatgttatggttttcaaggaaagtgaacagaacgagcaaggtagcaaatatcgcgtcattgctcaatggtcaggagatgaaaccactaaaggtatatatggaaaaatctatatcgctactcaggtttggacgactaaattgggaacaaacgagtggggatggtttgactattctgatgaccaagctggtataaaatttaataacaaaggtttttggccggcaggtgttcaaaatacacttcgaaatgctactccagctacagctgtagagactacttatatctacaaagaaagttccaagtatggtgatgtcattgttgagtactacgatactgacggaaaacaaattgtaaattcagttgtagatactcctaagtcagctcttggcacagagtataatacagatgtggaccgtagaccagccagcttggttgctgctgatgggacagtctacttctacaaagaagttaagtctgattcagctaagacaaccggtacagtagttgcaggtacgacaactgttaagtatgtttacgaaaaagctggtagcgttaatgttaacttcgttgacatcaatggtaaagtaatcaaagctcctgtttcagatgaaaaagatgcgaaacctggttacaattatgataccgacttggatcagaaattagcttccatcacttttgaaggcaaggaatacaaacttgttcctgctggtgattatccggttggtaaagttggcaagggaaataacttgattgaagttggtaataatactgcgaaaggtattgacccaacaacaggcaaaattgaagccggtgttaacaaagaagttacctatgtctatagagcagtgacaggttctgtagttgtaaattacaaagatacagaaggtaatgtgattaaagatccagaaacggatgtgtctgatgcaccggttggagatgcttatactacaactgacaagaaaccaaacgaaatcatcacaaaagatggatcacgctatgttcttgttccatctaagacagatggtgaggaaaatggtaaagttatcgaaggaacaatcacagtaacttatgtttaccagaaagttgcaaactggattccagagattccaaatgtaccagaaacagaccgtccaaaagtaccttacccatttgacccaacagagccagacgagccaatcgatccaacgacaccaggaacaaatggcgaggttccaaatattccttacgttccaggatatacaccggttgatcctaaggataacacgccgttgaaaccaattgatccaaatgatccaggtaagggttatgtaccaccaacaccagaaaatccaggtgttgatacaccaattccttatgttccagttaaaaaagtcgtaactaaccacgttgatgaagagggtaaccctattgcaccgcaagaagagggaacaaaaccaaacaaatcaatcccaggttacgagttcacaggtaaaactgttactgacgaagatggcaacacaactcacatctacaagaaaacaccagaagttaagaatggtacagttgttgttaactatgtaacagaagatggcacagttatcaaggaacctgtaacagatacaccaacttctccagaaggcacaccatacgacactacagacaacaaacctaagacaatcactttcaaaggtgaagagtatgaattggttcgtgttgacggtacagaaaacggtaaagttgtagaaggtgaaacagttgtgacttacgtttaccgtaaagtcgaaacacctgctaagaaagttgtaactaaccacgttgatgaagagggtaaccctgttgcgccgcaagaagagggaacaaaaccaaacaaatcaatcccaggttacgaatttacaggtaaaactgttactgacgaagatggcaacacaactcacatctacaagaaaacacctgctaagaaagttgtgactaaccacgttgatgaagaaggtaaccctattgctccacaagaggatgggacaacaccaaaacgtcaaatttcaggttacgagtatgtgcgtactgtagttgatgaagaaggtaacacgacacatatttatcgcaaactttctaataaaccaacaacacctgagaaggaaactcctgcaaaacctcaagcaggtaaaaccgcttcaggtaaagctcaattgccaaatactggtgaggcttcatctgtggcaggtgcgcttggtacagcaatgcttgtcgcaacacttgcgtttgcaagaaaacgtcgtcgtaacgaagattagtcaaaattctttatacagactttattcccccacatagaaagtataagaattgtacgtaacatgcaggattgcctttccgaaaaaatgaggctgggcaaaaagtccagagttacatcttagagttcgctccatttccaacctccaacagtcactactctgactgttggagctgtgtgggggtgggagacgagctctttttttattcggtcgagttctttctcgctcccatttttttgtcttattttgatatactagatatagtatattcaacgaaagcatgagaatttgatatgaaattagtctatacagatattcgcaatcctctgacgcagtatttgacagaacagacagcaacatttgccgagcagggcaaacgtgttttttatattgctccaaactctctatcctttgagatggaacgcaaggtcttggaatacctgcctgaacaggcaacttttgatattatcgtgacccgttttgggcaattggcccgctatttgatgattgataggaaagaagcaggtcaaccgctggatgatgttggtctggcaatgattttctttcgtgttctatcgcaatttgaagatggcgacttgaaagtctatggtcgtttacagacagattttggtttcattaaccagctagttgctttatacaaagaattgcaacgggcaaatatgtctattttggacttggaagccatggactcaccagataagcaggctgatttggtaaagatttttctggctgtaacagacattttgtccaaagaaggctttgagcatcagtctaagttagcacagttgactggcttggtagaaactggtcagttggatgagcagttgaagaacattgtgctggtggtagacggattttctcgtttttcggcagaagaagaagctttagtaagtgctttaaatgaacgggtgtcggaaatcctgattggtgtatatgccagcaagaaagctgtgcaagccacctatgcggaaggcaacgtctatcaagccaacgttgactttttacgtcagttatcagcgcagttccagactaaggcaacttatattggtcaagagccggtcttggacagtatcggtaaattttcaaagaatatggaagcctattatgactacagcgggaccatgatagacttgactccagcagaccaagaaaaaatccaactctgggaggttgttaaccaaaaagaagaagtggagcaagttgcgactgcaattcgtcagcatgtgcatcaaggtgctcgctataaagacatcttgttgctcttgggtgacgtggatagctacaagttgcagattggcaagatttttgacaagtatgacattccttactatttcggtaaggcagaggagatgagtcatcatccgttggtccattttgtggagtccttggagcgcttgcgtcgctatcgttttcgtgcggaagacctgctcaatctcctcaaatctggtttgtacgccagcatttcccaaaaggagctggacctatttgagtcttacatcctttttgcggatatgaaggggcaggctgctttttcgagggctttttcggtcaatggcagagcagactatgatgctgaagtcatcaaggagaaaaggcttgtctatgatttgactgtcttggaacccctacgtgctaagattatggaacctttgaaccagctgtttaaggctggaccacaatctggaactgccttgcttgagaaatttatggcatttttggaggcaattgatcttcctaaaaatatggaaaaaatgtctcgaaatttgagtgaagtagagcaagaaaaagaagagcaggtctggaaaagttttacccatcttcttgagaattttcatcagattttcggaaaagaaaagttgaaaatggatgattttctggctattttacaggctggaatgcaggccagccactatcgtaccgttcctgcaacagttgatgtggtcaatgtcaaatcctatgatttgatcgagccgcacactgcaaagtatgtttatgctatcggaatgggtcagtcaaattttccaaaagttgccaagaataccagtctattgacagaagaagagatggaaaaagtcaatcttgtctcggctagttcctcacgtttcgatttggtcagccgagagaatatcaagaagaaccatgctgctatgatgtctctgcttaattctgcgacggaacagttagtcatttctactcctcagatttataacgaaggcgaagatagtctctccccatatatcaagattctccaaaaaatggggttgaaatccgaagaacgtggtcggattaaaacacttagtccacaagacatcggtcactacaagagtctcttatcccgtttgattgagtcggaaagaccaagccttgaaacagaggagtgggaagggcagagggccttctggacagtcttggttcgccatttgaagaagaaattggagtcgcaaagcattgaaattccgaccattactggtgatattgcttctaaacaactttcagatgaaaccttggctgctttatatccagaggataagccgctcaatctttctgcatccagcttgaccaatttctacaataaccaatatctttactttgtccgtaatgttcttcgcctgcgggaacaggaatccatccatccgactgcctttcagcatggtttgttcttgcatcggatttttgaacgagtggtcatggaccaatctgagctagattttgatcaaaaagtggacaaggcaattctgcgtacgcgtgacgaggcagaatttgctatgttttataaccaggatgcggatgctcgttatacggaggaggtgctggataagattgctcgttccagtgcgactattttgcgggataatgatttggttgaaattgatggccaggaaaagagtttccgtcaggataaggcgctggtttttgaccttcaaaatggcaagagtgtgcatgtaaatggtaccattgaccgcttggataccttacaaatcaatcaggctgtcggtgttgtggattacaagtccagcgaccaatctttttcagttggggatttttataatggtctcaaacctcagttggtgacctacttggcagccttacaagagctggatgaaaccaaggataaacctgtttttggggctatgtatttgcatttgcaggatccgattatcaaattaaaagacacgaagaatttagaacagctagaaggagctgccaatactagcttggtttacaaggggcttttcttgaaggaggaaagtctggggctcaatcatttttatcagactcgtaaccaactctacacggaagatgagttttcggttttattgaaccacaaccaagaactatacaaacaagctgccatggacattctggctggtcgctttgctattaacccttataccaaagatgggcgttcggtggcaggtgagcagctgaaggcaatcactggttttgaggcagatcggcacatgggcatggcacggcggttggtcaaagaggccaagcgtcaagattggatggaacgaatgaaaggaggtcaggactaatggcttttgaacaatttttaagcgcggaagaaatcaaggctgtgcagctggcggaagcccattctgataagcagcaaaaacgcacagctgagcagattgaagctatctacacgcacggtcagaatgttctggtctctgcatcggctgggtcaggaaagactttcgtcatggttcaacggattttggataagttgaagcgtggtatagggattgaccagctctttatctcgacctttacagtcaaggcggctggtgaattgaaggagcggattgagaaaaagctcaatgaaactattgcggagacgaccgatatggaattgcgtcggcatttgtcggcccagttggcagatttgactaaggcggatattgggaccatggactcctttacgcagaaattggtgaccacctatggttatagccttggtatttctccgcagtttcggattttacaggatgagactgaaaaagcgagtctgaaaaaagaggtttttgaccagctctttgcagattatcttgaagaggatgaaaatggtgcattccgcaaactggttcgcaatttttcgggcaaccgcaaggataatagtggtttccgtcaggttgtttatcaggtgcatgattttagccaatcgacgagcagtccaactaaatggctgaaagaacaggctgttcaagctgatttgtacagtcaagagcgtatagagcagatgctagagcaaggctttaaggaaaaagtgttagacaagctctatcaagctgcagatttcttccgctaccatgtggaatggggcagaaatgactttgggtctgctaaatattttgcaaatgtggaagaagtcttggatttgttgacaggtttagatagtctggaccagaaggacttgatggaacgggttgaaagaattcttctcatcaataatcagtccagaggcaagggcctgaccaatgccaatcgaccaaaagatgagcatttgatagcctttaaagaagaatacaatgctggtaagagccagattatctcagaactacgagatttgggtcaggaagtttatgaattgaccctgctgaaagactatcaggttcaagctttgccactactgatattattacgtgactttgtcttggatttttcgcaggcttatctggatgtcaaaatcaaggaagcagcctttgaatttggcgacattgggcatttcgctattcgtattttagaagaaaatgcggacattcgccagtttttccaagagaaatatcacgaagtcatggtggacgagtaccaggataacaaccatagccaagagcgaatgctggacctgctgtctaacggtcacaaccgctttatggtgggtgatattaagcagtccatctatcgattccgtcaggcggatccgatgattttccaagagaaatttgaactgtatcaggcaaatcctcagtctgggaaattgattttgctcaaggaaaatttccgtagtcagattgaagtcttggaggcaacaaatgctattttcacgcgcctgatggaccgtcaagtaggggaaatcaagtatgacgacacccacagtctagtggctggtagtcctggtcaaaaaattgcccagcccaagaatgagatggaatacttgatttacgatcagcaggatagcgcaaactcttcaacagatgctgaggaagaaacacctctgactgctggtgaaattgaggtcgttgcaaaagagattattcgtcttcacaatgaagaaggagcagacttcaaggacatcactctcttggtacaaaagcggacgcacaatgacctcattatgtccatttttgaaaaacatgggattccaattgtggcagatggcggagcagcctcctatctgcaatctttagaagtcatgatcatgctggataccttgcgggttatcaataatccactcaatgactatgccttggttgccctgcttaaatcacctatgttccgattcgatgaagatgaactgacacggatttccttgcaggccgggacaggtttcttttaccagaaaatggaaatagcccagcaagcaagtgggcaacatcctgaactgatgtcagaaaagttgaagaagaaaatcacggatttcttgtctattttggaaaattggcgtgcctatgccaaactgcattctatttatgacatgatttggaagatgttcaatgaaaaattctactatgactatgtcggtgcgcttccaaatggcagcaagcgtcaggccaatctatacgcacttggtctgcgtgccaaccagtttgaaaaaacaggctacaagggattgtctcgcttcatcgccatgattgatcgtgccttagcaaatgacaaggacttggcagatgtacaagagtttctaccgcaaaatgctgtacagcttatgactattcacaagtcaaaaggtttggagttcaagtatgtcttcctcatgaacatcgataagcgatttaacttggaagaccattaccaatcagtcatcatcagccggaaaaatggtctaggtatccaatatttagcagatatgaaagataaggtaaatagcccattacctcaggtgcgagtcttaatgaacaccctcccttatcaaaataatctccaagagctaaaaattgccaatctttcggaacaaatgcggttgctttatgttgcactaacacgtgctgagaagaagctgtatctggttggaaagggtaatgctgacaagttagctgaaaaatacgatggcaaaaaggaaaatggcgtactagcccaatcaactcgtgaaagtatggcgaccttccaagactggattctagccattgatgaggccttctcaggagaagacttgcacttcaagaaagtctttgtgacggatgaggatttgacagaggagaagattggtaaacttacattgaagagtaagctagaagacgccagccttaaagatattcgtcaatcagaagacatcgcccaggccttggaccagttgtcttctgtccaagagttgaacgaacgctataaggctgctatagaattgccaagtttacggactccaagtcaaatcaagaagctctatgagcctattttggaacaagaaggcatggaagttatggaaaaataccagcccaaacggaccttcaacttgccagatttctccaagaaaccaaaaatcactggagcccaagtcggttcagcagtgcatgaactcatgcaacgcttggatctgtcttggttggtgacagaagatacggtaagagcagccctagaagctgttcatgctgagcaagcgattaaagataaaatcaatgttcagatgattttggatttctttgatacagacttaggaagagaaattctagccaatacggacaaactccaccgagaagctccatttgcaagtttgcagacagattctgtatctcaggaaaactttgtccttcgtgggattatcgatggctacctactgtatgatgatcatattgtcctctttgattacaagacagacaaatatgaccaaccaatccaactcagccaacgttaccaagctcaaatgcaactctatgcggaggcattgaaaaaagcctacaagatagatcgtgtagactgccatttgattttgcttggtggggagagaatagaagtggtcgaagtcaacatatagtcatttagtttttcttttattacttcgttaactcgctttgccgtactccagtactgtctgcagctcgttgcctagtactaaaagtaaactaaaagactataaataaattaaaagcgagtggttaaactcgctttttctgtttggttagattgagtccgaatgggacaaggttctcttcttttttcaaaatccgctggatattttccttgtgacggatgatgacaaaactgccaagaaagacgataatcactgtaaagagccagtcgtagcttggcaggatgattcctattgctggaaatagcagagctcctaagattgctaaagctgctgctaagacgctagagaaggaaaccatggacgtcaagtagagtgaactggcaaagattagaacgagatagaggcaaaaagcaggtgcgacgcccagaagcataccagcagatgttgcaaccgcctttccacctttgaattgggcaaagatagggaaagtgtgtcccagtacagccattaacccaaatacaatcggagaaattccttgggcatgaaagatcagcggaagcaaggctgccaacgttcccttgagaaaatcaattacaaatacaatcgtaccagcctttggacctaaaatacggaatgtgttggttgttccagtatttcccgaaccatgctcacgaatgttgatattgaaaaaagtttgacctatccaaagtcctgacgggatagatcccaacaaatatgcaataaatagtaaaataagattgactaacatgttttcattatagcatattttcatctaatttagtccaaaatcttattttgtgagctgtctcagccgataggtaacagaaatattttgcaaaaatgctaaaaaacttgtaatatagaaaggatgataagtatggaggtcagttttggctaagaaagagattgatataaataattacaatgacgatgccattcaggtattggaagggctagatgccgttcgcaaacgccctggtatgtacatcggctccacagacggaaatggcttgcaccacatggtctgggagattgtcgataacgctgtcgatgaagccctgtctggtttcggtgaccgaattgacgtgactattaacaaggacggtagtctgtccgtttccgaccgtggacgcgggatgcccgttggtatgcatgcaacaggcaagccaacagttgaagtcatcttcaccgttctccacgcaggtggtaagttcggtcaaggtggctacaagacttcaggtggtctccacggggttggttcttcggtggtcaatgccctgtccagctggttggaagttgagattacccgtgacggagctgtttacaagcaacggtttgagcagggcggaaagccagtcacgaccctagagaagattggtaccgctccaaaatcaaaaacaggtacaaaagttacctttatgcctgacgataccatcttctcaacgacggatttcaagttcaacaccattgccgaacgcctgaaagaatcagccttcttgctcaagcaagtcaccatgactctgacagatgagcgaacaggtgagcaggaggagtatcactatgaaaatggcgttcaggactttgtatcctacctcaacgaagacaaggaaactctgacacctgtcctttattttgaaggagaagatgctggtttccaagtccaagttgctatgcagtacaacgacggctattcagacaatatcctgtcttttgtcaacaacgttcggaccaaggacggcggtacccacgaaacaggtctcaaactagccattaccaaggccatgaacgactatgctcgtaagaccaacttactcaaggaaaaggacaagaacttggaaggctctgactaccgtgaaggtttgtctgcggtcctctctatccttgtgccagaagagcatttgcagtttgaaggacagaccaaggacaagctgggtagcccgcttgctcgccctgtggtggacggcattgtgtcggacaagctgaccttcttccttttggaaaatggcgagctagcatctaatctagttcgtaaagccattaaggcgcgtgacgcccgagaggctgcgcgtaaggcgcgtgacgaatcccgaaacggtaagaaaaacaagaaggataagggccttttgtcagggaaattaaccccagcccagtccaaaaatccagccaaaaatgaactctatctggtcgagggagattcggccggaggttctgccaaacaaggccgtgaccgcaagtttcaagccattctacctttgcgtggtaaggttatcaataccgccaaggcaaaaatggcggacatcctcaaaaacgaagaaatcaataccatgatttacaccattggtgcaggtgttgggtcggatttcactatcgaagatgtcaactatgacaagattattatcatgaccgatgcggacacggacggtgctcacattcagaccctcttgctgaccttcttctatcgctatatgcgaccgctagtagaggcaggccgggtttatatcgcccttccgccgctctacaagatgtccaaaggcaagggaaaggcagaaaagattgcttatgcttggtctgatggagaattagaagatctccgcaaggattttggcaagggctttatcctccagcgctacaaggggcttggtgagatgaatgccgatcagctctgggaaacgaccatgaaccctgaaacccgtaccctcatccgtgtcaccattgaagacctagcccgtgctgaacgccgtgtgtctgtcctcatgggcgacaaggtcgagccacgtcgcaagtggattgaagacaatgtgaagtttaccttggaagagagtacggtgttttagaaattgaaatacaattgtaagactacgttatgaaattacaaatttggaatgaatcttatagtctccaatggaagggaacctattttcttgctttgtctgactatcctaatattcaagattgggaattagagaaaattgtagcttttttagcttatgagaaactttacggcagagagacgctaatagattgtgaagacaaagtaatgcttgaacaacttgtctatttatcttgttgctcacccactgcatttccatttactccttcgaaaaagattgtggcctcaacatatgatgttggtggtaattacgtttattcggattttttaagtcatacgtgtactgtcgaaactgcacaagagattttcatgagtggtcaattattgtccgctgttcgtgcgttcaacaaaactcatcaagaactcgttcaggataatcgaaacgcagcaggtgatccagaagattattttgattatgtcatgctaggttggtcaaatacaagttctggctacagacttgcaatggaaagattactaggtagagaaccaacagaggaagagttggggaattcttttattccaggcgtaagttttcattttaagtacgacgatatagtcaatgcagatggttatgtttttgatggataccaccctgcaaaggtcagggattgtttaagtttgaaatatttgtttgcctgtattgttccttcaagtgaaaaatctcattttgagacaattattcccctagatatgtcttcaaaagtttattatttagactatggtcaggatgggatggcagattggtcccaaaaggtctatcaatttgttgaaaatatagcaaactaatactataaactattcaattcgatgatttgtgataggaatcgattgttcctaacgccgtgtatctgtctttatgggcgacaaggtcgagccacgccgcaagttgattgaagacaatgttaagtttaccttggaggaatcgacagcttttactaaataatctcagggaagttgaggtgccatatggttttagaaaataaattggagattgaaaattcggctgaattagcccgtcttgaagaacaaatcagcaagaaaaaagcagctcaactgttcgaaaatggtcagttattccagatagaagttggaacctttgccggtttggcacacattcatcaagctttatttgaggatatttacgactttgcaggtaagattcgtgatgtcaacattgccaaccaaagataattttcaattcgctccacgtatctttcttgagcagtctttggcctatatcgacaagctacctcacgaaacctttgatgaaatcgttgaaaaatatgcagatatgaacattgcacatccattccgagaaggaaatggacgcagtatgcgtatctggttggattgtatgctacgggatagtttgggtagggttgttgactggaatagcattgataaagatgaatatttcaatgcaatggttagaagccatgtgtcaacaggagagcttaaatatctgttattgcaagccttaacggaagatcttggtcaggctacttatttcaagggcatcgaccattcttattactatgagggttacaacctatatcgtattgaggatttgtaaatctagcataaacaaatgatgtgaggtgttttatgccactaagagtaaaattaactgaccgttttcaaaaacggttgtctgaatgggcacgaaagcgcaagccatttaaaaacaaacaggagttggaagagaaatttggccaagcattgaagatttggcaatcttccaaaactcggcaacatgcagaaaacttgctatctgagcaaggaaaattagaacattttttacatagcacggaacggaaactgtctcgtatgccttttggcggagataagtttgcggctattccaggcttgatttccatggtgcgaagctatatccgtagagattacagcaagttacccaaagcgacaatcctcgcaattataggtgctttgatttattttttcagtcctattgatgccttaccagatttcatccttggagcaggtctacttgacgatgcctttgtccttaatgcctgtttgaaattaatcaaaacagatgtcgatgactttagaagctggcaagcaagccagtggaaggcggaagagtagctatgataaagtttttaagaaaaaagccaactatcgagcaacttaagaaagttccttatgcttctcagtatacagaggttctacgttcaatttggcgagcagatgtgcctaaatacgggatttcttctactttacaaggtgaattacttcgacaattagaaaaacttcgctgggaagctcaagcaaatggcaatgtcaattggtgtgaagagcactcaaactactgtcgattcataaaggagactctctataaaggaaaactcctttcttctcaacagaagcaagagttagttttaataatggattatctaaaatcgtgtggtgaatatgctcaagcttatcaagaaaatttgattgatgatgaggaattagaaattgagaaattagcatatgttgatgacaatctttatgatagagtaggggatatgattgctttcttttatcagagaacttaggtaaagaactaatgtttagttaaggatatcgcaacagaaattgctatataagctctcttccgttcccactacttaaggtgattatcaaaaaagtaaaaaagaaagaaaatttaacttcccaccaagaaacaaagaaaggaatgttcggttagtagaaataactgaacacgggactgaatcgtccctttgtatcttaatttatgtcaaacattcaaaacatgtcccttgaggacatcatgggagagcgttttggtcgctactccaaatacattattcaggagcgggccctgccggacattcgtgacggtctcaagcccgtgcaacgtcggattctttattctatgaataaggacggcaacacttttgacaagggttaccgtaagtctgccaagtcagtcggaaatatcatggggaatttccacccgcacggtgattcctctatttatgatgccatggtccgcatgagtcaggactggaagaaccgcgagattttggtggagatgcacggaaacaacggttccatggacggcgatccgccagcagctatgcgttacaccgaggctcgcctttcggaaatggctggctatctcttggctgacatcgagaaaaagaccgtaccatttgcctggaactttgacgatacggaaaaagaacccactgtgctaccagctgccttccctaatctcttggtcaatggagcgacaggaatttcagcagggtacgcgactgacatcccgccgcataatctagcggaggtcatcgatgccgttgtctacatgattgatcatccaacagctaagttagaaaagttgatggagttcttgcctggaccagacttcccaacaggtgccattatccaaggggctgacgaaatcaagaaagcctatgaaactggtaagggccgtgtcgttgtccgtagccgttgtgaaatcgagcaactcaaggctggtaagaaacagattgtcattactgagattccgtatgaagtcaacaaggctgttttggtcaagaagattgatgatgtccgtgttaacaacaaggtgcctggtattgccgaggtgcgtgatgagtcagatcggacaggtctgcggattgccattgagctgaaaaaagatagcgatgagcaaaccattctcaactacctctacaaatacaccgacctacaaatcaattacaactttaacatggtggcgattgataatttcacaccgcgtcaggttggcttgcagaagattctgtccagctacatcgcccaccgccgtgagattatcattgcccgttctaagtttgacaaggaaaaagcagagaaacgccttcacatcgtagagggtttaatccgcgtcgtttccattttggacgaggttattgcccttattcgtgcttctgaaaacaaggcggatgctaaggaaaacctgaaaatcagctatgagttcagcgaggagcaggcagaagcaatcgtgaccttgcaactctaccgcttgaccaataccgacattgtgaccttggaaaatgaagaagcagccctacgcgagcagattcagaccttggcagctattatcggcgatgagcggaccatgttcaatcttatgaagaaggaactgcgtgaggtcaagaagcagttcggcaatcctcgtttgagtgaattgcaggatcaggcagaaacgattgagattgatactgccagtctgattgtcgaggaagaaacttttgtcagcgtgaccaaggcaggttacatcaaacggacaagtcctcgttctttcaatgcctcaacgcttgaagaaatgggtaagcgggatgatgaccagctgattttcttgcagaatgccaagacaactcagcacctcttgctttttaccaatcttggaaatgttatctaccgacctgttcatgagttgacagatattcgttggaaggacattggtgaacacctgagccagactctcatgaactttgataccaatgaagagattatcttcgctgaattggtagagaattttgaagaggggacttatttcgcggtgaccaaatacggtcaaatcaagcgtgtggagcggaaggagttcacgccatggcggacttacaagtccaagtcaaccaagtatgccaaactcaaagatgcagaggatgtggttattactgtatcgcctgtagtcttggatgacatcatgctcatgacagaaaagggctacgctctgcgatttaacatcgaagaagtgccaatcatcggtgccaaggcggccggtgccaaggcggttaacctcaaggacgaggatgtggtggctgcggcctttatcagcaataccagctccgtctatctcctgacccagcgtggtagccttaagcggatggcgacggaggaaatccctgtgaccagccgtgccaagcgtggtttgcaggtgcttcgcgaactcaaggctaagcctcaccgtgtctttgcggcaggtccagtcttgacggatcagggtgattttgatctctttagcacggcaaatgaagatgatacgacaagtcaaatccttcacgtgcagtccaaaacaggcaaactctatgaggttgatgtgacccagcttagcctgtctgaacgcactagcaacggtagcttcatttcggataccatttccgatgaagaagtcttcagagcctggatagactaaaaaagatgaaaagattgctcgcaaagaagtctttttgctatactgtagaggaggtaaatgctatgaaaattatcaaattatttttcagtataaaagtctatctatggcttgttctgtccttccttctgttattgtgtggtgtatggggatacggctacatctctggtgaaaagagtaatcagcaggaagtgagtgtccatgcggctattgagtctgtcgagcaagtcaatgaattggtatttctaaatacagctgtccagaaaattgtgaccgctaaaaactacacggtcttatttggtcaagaaatgcccttctcagaaaaatcagccctcttaattatcaagtacaaagcaaaatttggtatcaaaagtcctgtatccattgaacatctttctgaaaatcggtacaaaattacccttccagcctttgaagtcattggattggaattagatgcagaagaaccttataccttatatgataagagtggtgagatactgagttttgcgacagaagaaatcgatactgcccaactcatcacagatgaatttcagtcggtagagcaagaaaagtttttagcagattatcaggaagacataaaagagtcagccaaaaactactatcaaaatttatttagtgctatctcacctgaaattcaactagaatttgtttttaaagagtaagagtctggtttaccaggctttttcttatattcacaaaattttctgaatttttaattgaaaatcactttcaaaagtagtaaaatattaaaaaatgaatttggagaaactatatgacagtgaacattgactgggaaaaccttggtttttcttatatgaaactaccttaccgcttcatcgctcatttcaaaaacagccaatggtctgaagggcagttgaccgaagatgcggaattgcacatttcagaaagctcaccagcccttcactatggccagcaggcttttgaaggccttaaagcctatcgtaccaaggatggaaaactccagctctttcgtccagaccaaaacgctgagcgcctgcaacggacagctgaccgcttgctcatggagcctgtaccgacggatcttttcatcaaggcttgtaaagaagtggtcaaagccaatgcagactacgttcctccctatggaactggtgggaccctttatctccgtccgctcctgattggtgtcggcgacatcatcggcgtcaaacctgcggaagagtacattttcacagtttttgccatgccggttggtaactatttcaaaggcggcctggctccgaccaacttcctcatccaagacaagtacgaccgtgcggcaccaaatggaacaggggcagccaaggttggtggtaactacgcggcgtcgctcttaccgggccaatatgccaaaaagcagggcttctcagatgtcatctacctggatccagctacccacaccaagattgaagaagtggggtctgctaatttctttggtatcacagctgataacgagtttgtcacaccgatttcaccatcaatcttgccgtctattaccaagtattctctcttgtacttggcagagcatcgtctgggtatgaaggctgtggagcgtgaagtccttgtcgaagaattagaccagtttgtcgaagcaggagcttgcggaacagctgcagttatctcaccaattggtggtatccagattgcagacaaactccatgttttccatagtgaaacagaagtaggacctgtcactcgtaaattgtatgaagaattaacaggtatccagtttggtgatattgaagcgccagaaggttggattgtcgaagtagattaatttcagaaggcttgcacttgcaagctcttctctttttttgtagaatagtaaaagtgaggtttgaaaatgagtaaaaaagataaaaaaattgaaattcagattgaagatagcaaagttcttgtcaatagagaagagttccctggctaccgccttgttataggtaaaaaagtaattggagaaattgcagaattggctgaaaataactttgcagttattaaaaacggaaataccgaaagcttttacaaaaaattagaaaaagcagtcggaaatattattgaaaattataatttaagtcactaaaagacttgtaatagtcgctattttatgttagaatagtgactgttagtgtacggagagatagcgaagaggctaaacgcggcggactgtaaatccgctccttcgggttcgggggttcgaatccctctctctccattgaacaggatacaaaggacgttaagaaatccgtacgaaaataggaaattgacgcagtgtgctaaacacacagggaagtttatctttttcactaggattttagtccgtgttcaactaagatacgagatatgttctggtttaccagaaatttctgtagaaaattaggagactgacgctgagtgttaacactcaaggaaggctatctatttttctaagaaattaatctcgagttcaatttcttatgattagtaaataaatgaattgtatctattttttggggtatcgccaagcggtaaggcaagggactttgactccctcatgcgttggttcgaatccagctaccccagtaaaggtactagatatagtctagttcgtcaaagatgtctaattgttgttgtccttgcgtgtgccttaaataaaatatattttatgttgggtcgaaagacctgattgtcggaggtttttttataatgaacgaatttgaagatttgttgaacagtgtaagcgaagttacacctggtgatgtggtaactgcagaagtattgacagttgatgctggtcaagcaaacgtagctatctcaggtactggtgttgaaggcgtattgactcttcgtgagttgactaacgaccgtgatgctgatatcaacgaccttgtaaaagttggtgaaacacttgaattgttagtacttcgccaagttgttggtaaagatacagacactgttacttatcttgtatctaaaaaacgtttggaagcacgtaaagcatgggacaagcttgttggtcgtgaagaagaagttgttacagttaaagtaactcgtgccgttaaaggtggtcttgcagttgaatttgaaggtcttcgtggtttcatcccagcttcaatgatcgacagccgtttcactcgtaacactgagcgttttgtaggtcaagaatttgatgctaaaatcaaagaagttgatcctgctgagaaccgtttcatcttgtcacgtcgtgacgttgttgaagctgcagctgcagctgcacgtgctgaagtattcggtaaattggcagttggtgaagttgtgactggtaaagttgcacgtatcacaagcttcggtgcattcatcgaccttggtggtgtagatggtttggtacacttgactgaattgtctcacgagcgtaacgtatctcctaaatcagctgtaacagttggtgaagaagttgaagttaaagttcttgcaatcgatgaagttgaaggtcgcgtatcattgtcattgaaagctacacagcctggtccatgggatggcgttgagcaaaaattggtagctggtgatgtaatcgaaggtaaagtaaaacgcttgactgacttcggtgctttcgttgaagtattgccaggtatcgatggtttggtacacatttcacaaatttcacacaaacgtgttgaaaatccaaaagacgctttgtcagtaggtcaagaagtaactgttaaagttcttgaagtgaacgcagctgatgagcgtgtatcactttctatcaaagctttggaagagcgtccagcagcagttgaaggtgaagaaaaagctgaaaaacgtgctccacgtccacgtcgtcaaaaacgtgaagaaaaacgtgattacgaattgccagaaactcaatctggtttctcaatggctgatcttttcggtgacattgaattgtaattcatataaaaacttgccttgtgcaagtttttcctttccacccttagtgtaatggatatcacgtaagattccggttcttgagatgggggttcgattccctcagggtggactaaattgaaaagcctgcattaacaggcttttttgttatattatatcaaggaggctatgatatgttacattttgaaaatgactataacaaaggtgcccatcccgccttgctagaagccttagttgcaagcaaccaagaaggtttatctggatatggcactgataaatatactgaatctgctatcgaaaaaatcagacttgctacggactgtcctcatgcacaagttacgtttttagcaggtggcacgcagaccaatcaaattgtcatttcgtctatgttagcttcctatgaaggagtcattgcagcggatactggtcatattgcagttcatgaagcaggggcaattgaatttacaggccataaggtgttggccttaccgcatacggatggcaaacttgtcgcaagtgaagttgagaactatatttccgatttctacgcagatgctaatcatgctcacatggttcatccaggaatggtttatatttcccatccaacagagtatggtacactttatagcaagtcagagttagaagccttgtcaacagtttgtcgtcatcataacatcccgctttttttagatggagctcgtttgggttatggtcttgctgcacgcgatacggatcttgatttgaagacaattgcagagctgacagatgttttctacattggtgggacaaaactcggtgccttgatgggggaagctttggtatttacaaagaacaaccagcctaagaatttcgtatcgattgtcaaacaccatagtgccttgttggcgaaaggaagagtgacaggtatccagtttgattgcttatttactgatgacttgtatcttgaattggggcgtcatgctatagcaatggcagagcaactgacccagattttggaagagaaaggctttcaattctatctcaaatccccgaccaatcagcaatttgttattgttaagaatgaagaattgactagattgacagaagttggaattgcctatggcttctgggagaaatacgacgatagccacagtatcatccgctttgcgaccagctggtcaactagtcaagcggatattgatgcgttaaggaatagattataattaataaaaaagaaagggttagcctttctttttagtttgtaaataatgatagcgataaactgcataacgttcaataaggcggtagcctattccccctgcgattgcatgtacaatcagggcaatgtgcaattctagtggtgcttttatagtgataccaaatagaataccgattacagtccatcctagtatcacccaccataagtacttaaatggagcatactgaccatcctggtctttaacttcactggaaaccctgattgaacaaccggtcaatactcccatggggagcaatgaacgagtatcaaatggttctggtaaaaatgacgataaggcgaagatttgtataagcgcaaaaatcagtagccaaacgaaaatcggcgtttttagaatgacgtatttcatattgcacacctcttgaaattagtatatcaaatccaagaatgtaaaacaaatatttttgtgctattgattagaagtcgtttcggatgccccactagttacctctgtatcagtactggtttctgtccttgtctccaaagcttgggtagcagacgtttctgtagacgaggaagagacagtcgactctactaaagagctggtctcggtttgggttgaggatgttgtttcggagcttgaacttgttgaatcttgtacttctgttaatggattgtcgcttgatgattggctggggctagtggcgctggatgatgaaatggtagtacttggagatgttgaggatgttgcaggttttgctgtaaaggtgtagatagtgatgcaggcagtgataatccctaaaatagacccgataaaggttaaatatttttgaaaattagttaaaccagccggttttttatttgtattcttacgtgtattcatgatgtacctccacctttagtttaagataggaagtttaaaactatcttaaagattgccgaaaggcatgaaaacatgataaaataggactattgcaataaaaggaatataaaaaatgatttattttgataatgcggcaacgacacaggtctatccagaagttctcaagacctatacggaagtggcgacaaaaatctggggaaacccctctagcctccatagtctaggcagtcaggcaacccgtattttggaagcatctcgcaagcaaatcgcagaattgcttggccaggatagcaaagaaatctttttcacctcaggtggtacggaaggtgacaactgggtcatcaagggagtggcatttgaaaaggcacacctgggcaagcacatcatcgtttcggctatcgaacacccagccgtaaaagaatctgcgctttggctcaaaacgcaaggttttgaggttgatttggctccggtcaatgcccaaggttttgttgatgtttcagccttagaaagcttgattcgtccagataccacactggtttctatcatggccgtcaacaatgaaattggtgctattcagcccattcaggaaatatctcaactgttagctgataagccaaccatctcattccatgtggatgcggtgcaggctatcggcaaagtgccgacggaacggtatttgacagaccgagttgattttgccagtttttcaggtcacaaattccactctgtcagaggagtaggtttcgtctatatcaaagctggcaagaaaatcgctccgctattgacagggggaggacaggaaagcgataaacgctcaaccacggaaaatgtggctggcattgctgcgacagctaaggcgctccgcttgaccttggacaaggcagcagatagccaaaagcgactggcagccatgaagcagatccttgtggatgaattgggcaaatacgacgatgtgacagttttttctgggctagaggactttgtgcccagtattgtaactttcggaattaaaaacatccgtggcgaggtcattgtccatgcctttgaagaccaccagatttacatttcgacaacctcagcctgctcgtccaaggctggaaaaccggctggaaccctaattgctatgggggttccgcagaagttggctcaaactgccgtccgtatcagcttggatgatgacaacgatatggggcaaatcgaacaattcctcacgattttcaaacaaatttatcaaaacacacagaaagtaaggtagaatgaactattcagaaattatgattcgctatggcgaattgtcaactaaagggaaaaacaagatgcggtttgtcaacaaactccgcaataatatcaagcatgtcctttctgtttacccagaagtgaccgtttattttgaccgtgaccgtggtcatgtctatttgaatggggcggattatcaggaagtttcagcttctttgaagaagatttttgggatccaaaatttcgcaccgtcttataagattgaaaagtctgttccagctttgaaagaagcggttgtggaaataatgcagaccatttacaaggaagggatgaccttcaagattgctgcgcgtcgtagtgatcacagttttgaattggacagccgtgaccttaaccaagtccttggagatgcggtttttacagctattccaaatgtacaggtacagatgaagtcaccagatattaccttgcgagtggaaatccgtcctgatgctgcttatatttctcatgaagaaatcaagggggcaggcggtctgccagttggaacatctggaaaaggaacgcttatgttatcaggtggtattgattcgcctgttgcgggctatttagcactgaaacgtggggttgaaatcgaagccctgcactttgcaagtccgccttatactagcccgggtgcgcttaaaaaagcccatgatttgactcgcaaattgactgcctttggtggtaatatcacctttattgaagtgccgtttacagaaattcaggaagaaatcaaggaaaaggcacctgaagcttatttgatgaccttgacacgtcgcttcatgatgcggattacagaccgagtacgggaagagcgtggtgccatggttattatcaatggtgaaagtctaggacaagtggcaagtcagaccctggaatccatgcaggctatcaatgcggtgacaaatacacctgttatccgtccagtcgttaccatggacaagttggaaatcattgatattgcacaagaaattgatacctttgatatttccatccagccatttgaggattgctgtaccatctttgcccctgaccgtccaaaaactaaccctaaaatcaaaaatgtcgagcaatacgaggctcgaatggatgtagaaggcttggtggaacgagctgtggctgggattatcgtaactgaaatcacaccgaaagaagaagtgaaagacgaagtggatagtttaattgaagacttactgtagaattcaattgttttggcatacatttaaatccagctattgctggattttttaatacgaatcgttcggaaaaatcgaatttgtatgatataataagacttcagaaaaaaacaaaggagttattatgaaaaaaggagcactaacaggattactcctgtttggtatgttttttggtgcaggaaacttgattttcccacctgcacttggtgtcttatctggtgagaatttctggcctgctattttaggatttgtcgtttcgggtgtcggtattgcagtcattgccctgattgtcggaacattgaaccccaaaggttatgtacatgagatttctcgcaagatttcaccgacttttgcaacgatttatcttgttgccttgtatttggcgattggtcctttctttgccattccgcgtacagctacaacgtcctttgaaattggtattgcgccattattgggcgatgcgaatctcggtctttggttgtttggctttacagctctatactttgtggcagcttatctgattgccctcaatccatctcaaatcttaaatagtatcggacgtattttaacccctgtttttgcgattttgattgtgattttggtggtgcttggtattgttaagtacggatcaacaagtccgttaccagcttcggaagcttactcagcaggacaggcatttggtacaggatttatcgagggatacaatacactcgacgcacttgcttctattgcttttagtgtcgtagcagtaaataccttgaaacaacttggtttctcaagcaaaagggaatatgtatcaactatttggtctgttggcttagttgtagccttggcattctcagctctatatgttggtttggcttttttaggaaatcattttcctgtgcctgcggatgttttggcttccgataccaacaagggtgtttacattctttcgcaagcaacacaggctatttttggaccaggtgcacaaattttcttagctgctatggttatcgttacttgctttacgacgacggctggcttgattgtttcttcaggtgaatttttcgctgagcgtttcccacgttttagctacaaagtatatgcgactatctttaccttgattggctttgggattgccaacctcggtttgaacaatatcatcaccttctctgttccagttcttttggttctctatccaatcactatctgtattgtcttgattaccattgttaacaaatttgtaccgctttcgacttatggtatgcaattaactgtgggacttgtgacagctttgtcattggtagaagtgttagcaggacaattcaactggactgctgtttcaaaaatcatctcagctctgccattggcaggacaatcattagcatggttattaccagctcttgtcggaatcgtcctctctctattcttaccaaacaagcaggagagcgaagtttttgaaatgtaaaaaaatgatacaaaacacttgcatttgcaggtgtttttgttataataggactgttgactatgcacacatcctgtgcaaccgcacgaatgccgttctttcgttgagagtagagtaagtggttcgtcccacggtactaggcgagtcttcacatcaaattcgggtaagacccaaaaatcataggaggtgcataatgagcacatatgcaatcattaaaactggcggcaaacaagttaaagttgaagtcggtcaagctatctacgttgaaaaattgaacgttgaagcaggtcaagaagttactttcgaagaagtagttcttgttggtggtgagaaaactgttgtgggtactccactcgtagcaggcgctactgttgttggtactgttgaaaaacaaggtaaacagaaaaaagttgttaccttcaagtacaaacctaaaaaaggtagccaccgcaaacaaggtcaccgtcaaccttacacaaaagttgttatcaacgctatcaacgcttaatcgcgtagcttgaagcaatcattacagaaattcggaggaataacatatgttaaacttgaatcttgctaacttgcaatttatggcccacaaaaaaggtggaggttcaacgtcaaacggtcgtgactcacaagcgaaacgccttggtgcgaaagctgctgacggccaaactgtatcaggtggttcaatcctttaccgccaacgtggtacaaaaatctatccaggagctaacgtaggtcgtggtggagatgacactctttacgctaaagtagaaggcgttgtacgcttcgaacgtaaaggtcgcgataagaaacaagtatctgtttatccaatcgcaaaataagtctgaaaatggctttacaataggctttccgagttgttttcggagagtcttttttgtaatttgattttgctatttttaaaagtgtacgatagaagtgatttaagacggcaatatcttctctataggataaaaatattttgccatctgcactgttgcgctgcctataagttctacgttcagtagtagatgaaatgttcagaggaagtggtatgggttccaacttagtaaaattagtcattgatgatttggcgaacagaaattccaaagcctttcaaattgcagttgaagaagagaaattgggaacctggaagttatacaagaaattagttttgaagaacaggacgggctagtctatttgcgaaaacgcaagagttcagcaaattcttgctttttttgatataatggtagaagcagttttaagaggtatcaggtatgaatattcaacaattacgctacgttgtagccattgcaaacagtggtacatttcgagaggcggctgagaaaatgtatgtgtcccagcctagtttgtccatttccattcgtgatttggaaaaagagttaggttttcaaatttttagccgaactagttcaggaacttttttgacacaaaaagggatggaattctatgagaaagctcaggctttagttaagggatttgatcagtttgagcatctctatttgcaacctgaggaaggtgagaagactttttcaatttcaagtcagcattatgattttcttcccccattgattacggagttctctcgtagccacccgcagtaccctcattttcgcatttttgaatctactacagtacagattttagatgaggttgctcaaggttatagcgagcttggtattatttatttgaacgagagaaatacaaaaggaatcatgcagaaattggataaacttcacttgcaagctgtagatttgtctgcatttcagactcatatctaccttcgtgaagatcatcctttgacaaagaaagctgagattgatccagtagatttggtaggtctacctaccgtacggttcactcaagaaaaagaggcttatctttattattccgagaacttgattgatacgtcggattcctcggtggtgtttgatgtgacagaccgtgctactttgaatggaattttggagcgtacggatgcctatgcaactggttcgggctatcttgatgacgagagtgtcaatggcattaccgtaattcctctcaaaggaaaggtagacaatcgcatggtctacgttaaacgagctaatgatgaacttagttcttgtgccaaagactttattgaaaccatgcaggcatattttgataagaagaaggatgaaaatgcgtaaaattggatttccatttttgatggtagtattaattggtttggaccagtttgtaaaagcttggacagttgccaatattgaattagatacggtaacggaatttataccaggattgatgagcttagcttatctaagaaattatggtgctgcctggtcgattttacaaaatcagcagtggtttttcacgataatgacaattgttgctgtgacaggcctagtgtggtactatatcaaacagattaagggcaatatctggactttattcagtctgtctttgatgattgctggtgctcttggaaattttattgatcgtcttagattgggatatgtggtggacatgtttcacttggattttattagtttccctgtatttaatgtagcagatgtttgtctgacagttggtgtaggtattttatttatttgtattatgaaagaagagagtaatggaagtaagagttgaggttggtggtattcgtttggataaggcattgtcagatttgacggatttgtctcgttcggttgcaaatgagcagattaaggctggtcaggttttggtcaatggacagcctaaaaaagctaaatatagtgtgcaggttggggatgttctaacctatcaaattccagaagtagaagaaatcgactatgttgctgaggatattcctttagagattgtctttcaggacgaggatgttgctgttgtaaataaacctcaagggatggtcgttcatccgtcggctggtcacacgtctggaacgttagttaatgctctcctttatcacgtaaaagatttgtcaggcatcaatggtgtcttgcgaccaggtattgtccatcggattgacaaggatacatctggcttgctcatgattgctaaaaacgatgatgcccatacaaagcttgctgctgaattgaaagataagaaatcccttcgtaagtattgggccattgtacacggcaatctaccaaacgatcgcggagtaattgaggcgccgattggtcgttctgaaaaagaccgcaagaaacaagcggtgactgccaaagggaaagaagcggtgacacgttttcaggttctggagcgttttggtgactacactttggtggaattgaccttggaaacaggacgaactcaccaaattcgcgtccacatggcttatattggtcatccggttgcgggtgatgaagcttacggcccaaggaaaacactaaaagggcatggccaatttcttcatgccagaacgcttggatttacccatccgagaactggtgaggttgttgaatttacggcagaagcgccagctatttttcaggaggcacttgaaaaactgcgcaaggctgaataatagtatgaaaaccttatcatcttgcccattttttcaacaaatgctatactagaacatgaaaaatgttaaggagagtaagaatggaaactttaccaaattgtccaaaatgtaattctgaatatgtctatgaagacggtgccctcttggtttgccctgagtgtgcatacgaatggaacccagcagatgtagctgaggaagaaagtggacctgttgcaattgatgctaacggtaatcgtttggcggacggcgatactgtgacgcttatcaaagatttgaaagtgaaaggggcgcctaaggaccttaaacaaggtacacgtgttaaaggcatccgtatcgttgaaggtgatcacaatattgattgtaaaatcgatggtttcggtgccatgaagttgaaatctgaatttgttaagaaaatctaagagagaggactggttaaccagtcttttcctgtttttgaaaggatattatgaaacatcaaagtattttgttttacagtagatgcctgttagctattttagccatcacaggtaccgccttagaaatcattaaatattgtatcgggatgctcatgtattatacggtacaatctaatttattagtatctctgttcgctgtctatatggtctatgccatgagtaagggtgtggatttacagacgtcacgttttcttcggataaaggctgctgtaaccatgtctatcatgattacctgtgtagtctatcactttatgttggcacctttggcagacgatttctggcgacttgaaaatctactctgccattatattgttcccttatattttttgttagataccctaatagtagatcgtcagcaacagtacaagtggtttgacccgatttggtggacgcttttgcctgttctttacatgatttttggtctagtgaatggtcttttcataaaaattccaatcccagatgctaaggacagtccttttgcttatttctttctcaatgtccctaagtatggttggacctatgttttgacttatgctggagtcatctttgtcgcctatctagtctgcggttttctattggcgggactaaaatccataaaccttaagacttcattgtcttttggaaaaaattctcagtaaaatccgataatttctatattttttcagaaaaaaattgtcaaggctgagattttatgctatactctgcttaataaatcctttaaaacctgtccagagaggcagacaaggagtcggatgttaagcaggttggttctaactagcctatattttcatagtctccttgtataaggagactttttctatacttttggaggtcttatgaagacaaaagaaatcgttgacgatatgactatgaaacgggcaatcacccgcatcacttatgaaattatcgaacggaataagaatttggataatattgtccttgcagggattaaaacacggggtgttttcattgcaaagaggattcaggagagacttaagcaattagagggtatcgacgttccgttgggtgagttggataccaaaccgtttcgagatgacatgaaggtagaagatgatacgacaaatatgactgccaatgtcaacgatcgtgatgttatattagtagatgatgtgctttatacaggacgaactattcgtgctgctattgacaacatagtgtccttgggccgtccagctcgtgttagtttagcggtacttgtggatcgtggacacagggagttgcctattcgagcagattatgttgggaagaatatcccaactagccgttctgaagaaatcattgtgcacatggctgaaatcgatggtcaagacgctgttcttctggttgaaggtgcatagtcgcttcgtttacaaattctcattctacatctagatcataaaggtaggtatcatcatgacaattacaaatggtaaagtttcactcaaacacttggttacaatggagaccctctcaaatgaagaagtattgggactcattcaacgtggtattgcttttaaacgcggtgaaaaggtagagttagatcggaagtactatgcttctaaccttttctttgaggattcaactcggacgcataagtcttttgaaatggcagagcttcgtttggatatgggaatgattgactttgatgctcgtaccagctcagtcaataagggtgaaaccttgtgtgataccattttgaccatgtcggcacttggggtagacatctgcgtgattcgtcactcggaagtggattattacaagcaattgattgatagtcctaccattcagacttcaattgtcaatggtggtgatggttcaggtcaacacccaagccaatccctacttgatttgatgactatttatgaagaatttggaacttttgacggcttgaagattgccattgcaggtgatattacacactcacgggttgctaagtccaatatgcaaattttgaagcgtctgggagctgagattttctttgctggaccggaggaatggtacgcagaggaatttgacgtctatggtcagcatttgaatattgatgatattgtggaaacggtagatgtactgatgttgctccgtgtgcaacacgagcgtcatgatggtgatggtggtttttctaaagaaacttataaccgtttgcatggtttaacagaggagcgctacaaacgcttgaaagatactgcaattgttatgcatcctgcccctgttaaccgcgatgttgagattgatgattctctagttgaagcacccaaatcacgtattgtccgtcaaatgcagaatggtgtatttgtccggatggcgattttggaagcaattgtcaatggcaaggcttaaaagtaagctgttcaggtatcttagaactgagcagttagaaatttgttagacttatcttatttaatgtcgcccagagaggcgacgaatagaaaggagaaggtacaggttcgagtaagatttgatttttatattcgaacacgccctaaggactgtgtgaaaaagataaatatcgacttgacgcctatagcgtcggcgccgaatttcctattttcactttgtccttttaacgggctttgtatcatagattatgtcaaaaagacgtttaattttggaaaatggcactatttttgagggggaggccttcggtgctgatattgatgtgactggtgagttggttttctcaactgggatgacaggttatcaggaatccatcacggaccagtcttataatggtcagattttaacctttacctatcccttggtaggaaattacgggattaaccgtgatgatttcgagtcgatcaaaccgacttgtaagggagtggttgttagcgagtgggctcgtcgagcaagtaattggcgtaaccagatgactttggatgaatttttaaaggctaagaaaattccagcaatttctggaattgacacacgcgccctaactaaaattattcgtcagcacgggaccatgaaggcgacattggcaaatgttggtgattccgttgagcatttgacagaccagttgagagcgactattttgccaaccaacaacatccagcaagtatcgacaaaaacagcctatcctgcacctggagttggacgtagtgttgttttggttgattttggattgaaacattctattcttagagagttagccaagcgtgattgcaatgtgacagttgtcccttatgatacgactgctgaagaaattcttgccctcaatccagacggtgtcatgctttcaaacggtcctggtaacccagatgatgttccagaagctttggacatgattcggggcattctcggaaaaattccaatttttggtatctgtatggggcaccaactctttgctaaagcaaatggggcaacgacttataaaatgaagtttggtcaccgtggtttcaaccatgctgttcgtgaaattgcgacaggtcgagtggactttaccagtcagaaccacggttatgcagtggctcgtgaagatttacctgaatgtttaatgattactcatgaagaaatcaatgacaaatcagtagaaggggtacgccacaagtactatccaggtttctctgttcaattccacccagatgctgcacctggtccacatgatgccagctatttgtttgacgaatttatggaattgatggattcgtttaaaaaagggcagtaaggcttaactactatcgagctaaaccttactgcgtcggtcagagcaagtcggacttcatgctaacgcatgtgtcctcctacgcaaagtccaatgggacctttgctaactctgacactagtttagaatttcaattattatcgaattgagattctaaacgtcggacttatcttatttaatgtcgctcagagaggcgacgaatagaaaggagaaggtacaggttcgaataagatttgattttcatattcgaacacgccctaaggactgtgcgaaaaagataaacgtcgtcttgatgcttgaagcatcagcgtcgtgtttcctattttcgctttgtcctcttaacgggctttgtatcatacattatgccaaaacgtacggatattaagaaaataatggtgattgggtctggtccgattgtgattggtcaggctgcggagtttgattatgctgggactcaggcttgtttagccttgaaggaagaaggttacagtgtggtcttggtcaattcaaaccctgcgaccattatgacagacaaggaaatagcagacaaggtttatattgagccaattacgcttgaatttgtcacacggattttacggaaggagcgtccagatgctttcttgccaactcttggtggtcagactggtctcaacatggccatggaattgtctaaggctggtattttagatgagcttggagttgagttgttgggaactaaactgtctgcaattgatcaggcagaggaccgcgacctcttcaaacaactcatggaagatctcaatcagcctattcctgagtcaacgattgtgacaacagttgatgaggctttggaatttgctgctgaaattggttatcctgtcattgttcgaccagccttcacgctgggtggtactggcggtggtatgtgtgccaatgaagaagaactacgtgaaatagcagaaaatggtctaaaattgtcaccagtgactcagtgtttgattgagcgttccattgctggtttcaaagaaattgaatacgaagtgatgcgggatgcggctgacaatgccttggtcgtatgtaacatggaaaactttgaccctgtgggaattcatacaggagattctatcgtatttgccccaacgcagacgctttcggatattgaaaaccagatgttgcgtgatgccagtctcagcattattcgcgccctcaaaatcgaaggtggctgtaatgtgcagttggcattggatccacatagtttcaaatattatgtcattgaagtaaacccacgtgtgtcccgttcgtctgccttggcatccaaagcgacaggttatcctattgccaaattggcagcaaaaattgcggttggcttgaccttggatgaaatggtgaaccctgttacaggaacaacctatgccatgtttgaaccagctcttgactacgttgtggcaaaaattccacgtttcccatttgataagtttgaaaaaggggaacgccgccttggaacgcagatgaaggcaactggggaggtcatggccattgggcgtaatatcgaagaaagtctgctcaaggcctgccgttctttagaaatcggtgtttaccacaatgaaatgccagaactcagccaagtgacagatgaccaattggttgaaaagattgtcaaggcacaggatgatcgactcttctatctttcagaagcccttcgacgtggctataccgtagaagaactggctcaattgacgaagattgatcttttcttccttgataagctgcttcatatcttagaaatcgagcaggaattggcaacgaattttgataatattgatttattgaaaaaagccaagaaatacggttttgcagaccgcaagattgcggaactctggggacggacagaatcctacattcgtcaactgcggacagaacacaagattgtccccgtttacaagatggtagatacttgtgcggctgagtttgaaagtgctacaccttatttctattcaacttatgagtgggaaaatgagtccatccgttcggagaaagaatctgttttggtgctgggttctggtccaattcgtatcggacagggtgtggagtttgactatgcgacggtacattctgtcaaggccattcaggcagctggctacgaggccattattatgaactcaaaccctgaaactgtgtcaactgagttttcggtttcggacaagctttatttcgagccgttgaccttggaagatgttttgaatgtgatcgaccttgagaaaccaaaaggggttatcgttcagttcggtggccagacggctatcaatttggcagagccattggccaaagcaggcattccaatcttggggacacaggtggcggatttggatagagctgaagacagggatttatttgaaaaagccctgaaagacctagggattccacagccaccaggccaaaccgcaaccaacgaagaggaagctcttgaagcggcccgcaaaattggtttcccggtacttgttcgtccatcatatgttttgggcggtcgtgctatggagattgtcgaaaatgaagaggacttacgttcttatatgagaactgcggtcaaggcttcgccagagcacccagttttggtggattcttacatcgtcggtcgtgagtgtgaagtggatgctatttcagatggtaaggatgtcttgattccgggtattatggagcatatcgagcgcgctggggttcactcaggtgactcgatggccgtttatccgccacaaaccttgtccaaagaagtgcaggcgaccattgcagactacaccaaacgcttggcaatcggtctcaactgtatcggtatgatgaatatccagtttatcatcaaggatgaaacggtctatgtgattgaggtcaatcctcgtgccagtcgtacggttccattcttgtccaaagtcacagacattccaatggctcaggttgcaaccaaattgattttgggacaaagccttgcggaacttggctaccaagacggtctttatcctgagagcaaccaagtgcacgtcaaggcaccggtcttctcgttcacgaaactagctaaagttgacagtttgttaggaccagagatgaagtcaaccggtgagattatggggtcagacttgacactggaaaaagcgctttataaggctttcgaggcaagttatcagcacctggctgagtttggcaacgttgtctttaccattgcggatgaagacaaggaagaagtgcttggtctggctcaacgtttctatgaacttggttatggcctactggccacggcaggaacagccacctttctaacagaaaatggacttgctgtaacaactgttggtaaattaggcgatgattcctgtccagatattcctagtcttgttcgggcaggtaaggttcaggctattatcaatacggttggtaaaaaacgggtggcagatggtgacggtcaagtcattcgaagctctgctattgaaggaggaattccgctctttacggccctcgatacagcagaagctatggtcaaagtgctggagagtcgtagcttcatgacacaggctatatagaagatactatcaggatgagctttgaattcgtcctgattttttgatatactgaagagtatgaaaatgattgtaacaactagtcttgggatggatgaggggctggtctatagggctagacggattgccagtgaactgggaattgaatacaaggaaagaaagaagcagtcggttggaaaaatgttaggtacctacgaggctgtcttggttctttataaggataaattgatactagagcagaggggtgggcaggttttatttttccacccagatactgccatgttgcggattaagtctggaagagatccgcttttagaattacttggaaaagaaaaacaatcaataatagactgtactatgggcttgggatctgatagcattgtgttagcaagtgccggtcatcgggtgacagccttggaaagttctaagctagtgcactttattgtgagtcgaggtttacaggattttgatagtgggctgcaagaggtcaatcgagccatgaaatctattcagacaatttggacagatagtttgacttatttgaaagggcaaatagataagtctgttgatgtcatttactttgatcccatgttttcagaagaaatcaaggaatcacaaaatctttctggcttgtctactttggctgacagaagccgtttaacggaggaaattgtatctgaggctaaacgagtagctaggaagaaattgataataaaggctcattttcgagatcaggtctttgaagaatttggctttaaacgtcatgtcagacccaatcaaaaatttcactacggagaaattattttggaggaggaagtatgaaaatcatcgtaacaggctttgatccctttggcggcgagcctattaacccagccttggaaacaatcaaatctctacctaagaccattgctggtgcagagattattcttgtagagattccgactgtttttgacaaggctgcggatgttttagaggagaaaatggcagaacatttacctgatgcggtactatgtattggtcaggctggtgggcgagttgatttaactcctgagcgtatagccattaaccaagatgatgcacgcattccagacaatgaggggcaacagccgattgatagaacgattcgagaagatggtcagcctgcttatttctccaccttacccatcaaagcaatggttgaagctattcataggattgggcttccagcttctgtttctaatactgctgggacctttgtctgcaaccatctcatgtatcaagctctttacttggcggagaaacaatttccaaagactaaggcaggctttctccatattcccttcttgccagagcaggttgtcgacaaaccaggactggcttccatgtctttgaacgatattgtaagaggagttgaagtagctataggagcgattgttgaatatagggataaagaggatattaaaaagggtggtggcagtacacactgatgaaaaatattatggaagcaagaaaacgtgtagaggaaatggaaaaaatatttaacagacagctagagctgaaccagtccctttccgatagtatggcacaactcaaccaggaacaatcgacttatttacagttattagattattaccagagccagacctatatggaagatcttgatttatctaataagggttatttcaatggtattccttgcggagtattgagtgaagatggagtctataatttactgtttgaccgtacaaatctagcaagtcaactgagagaactagcagatatgctcgaacaataaattttttaaaacctgtcaagtttttttcttgacaccctgttaaagtgtggtataatagaacatgtgctaaatagctctgctatttcaccgaataaaaatacaaagaaaagagaacatttaaaaatggcagtaaaaatccgtttgactcgtatgggttctaaaaagaaacctttctaccgtatcaacgttgcagactcacgtgcaccacgtgatggtcgtttcatcgaaactgttggtacttacaacccacttttggctgaaaactcagtaactcttaaagaagagcgtgtacttgagtggttggcaaaaggtgcacaaccatctgatacagttcgtagccttctttcaaacgctggcgtattgaagaaattccacgaacaaaaattctctaagtaagaacagtaagcgagaacacttatggacatgattgaaaatctcattattgcgattgtgaaacctttgatttcacagcctgatagcttgacaataaaaattgttgatacacctgaattcttggaatatcatttggatttggatcaatctgatattggacgtatcattggtagaaaaggacgcacaatttctgcaatcagaacgattgtctattctgttccaacaagtgataaaaaagttcgtttagtgatcgacgagaaagaatagaaagtcaccgtttggtggcttttaacgttgacaaaggggcctagcccctttttaacatatagaaaggaagaaatgatgaatctgatttggacctatttgaaaaaatatcctaagtggattgccttagacttgttgggggccttcttatttgtagtggtaaacttaggcttgccgacttttttggctaggatgattgaccaaggaattacaaagaacgatgttagtcagctctatttctgggcggggatgatgggattgattgtcctgctcgggattgttggtcgagtgacacttgcctatgcagctggaaagttaactacaaatatcgtcaaggatattcgaaatgatctgtatgagaaaattcaggactattctcatcatgaatatgagcagattggtgtttcttctctagttgctcgtatgacaaatgatgcttttgttctcatgcaattctctgaaatggtcttaaaactaggtattattacccccttgatgatgattgcttctgtcatcatgaccttggtaaccagtccgagcttagcctggacagtagcagtagccatgccgtttctagtttttgttattttctatgtggcaacaaaaactcgtcctctctctgaaaaacaacaaaaacgtttggatacgatcaaccaatatgttcgtgaaaatctcatgggcttacgtgtcattcgtgcctttactcgtgaggagtttcaagaggagcgctttgagtcggtcaatgaggaatataccgatatttccaaaaagctctttaatctgactggattgacagagcctctctttgtccagattatcattgctatgattgtggccattgtctggtttgctttggatcccttgaaaacaggcagtctgcaaatcggtgatttggtagcctttatcgaatatagtttccacgcgcttttctctttcttgctctttgctaacttgtttaacatgtatccacgtatgtcggtatcgagccaacggattcaggaagtcttggacatgcccatttccatttctaagaatgaagacggcataactgaaacagatactcgtggttatttggaatttgaaaatgtaacttttgcctaccctggtgaaacggaatcgcctgtgctgcacaatatttccttcaaagctaagcctggtgaaacgattgcctttattggttcaacaggttctggtaagtcttccttggtcaacttgattccacgtttctatgatgtgacacttggtcgtatcttggtggacggtgtggatgtcagacgctacaatctaaaggcactccgcagcaagattggctttattccgcagaaagctctgctatttaccggaactatcgcggaaaacttaaagtacggtaagatggatgctagtcttgcagaacttcatgatgcgacggatgtggctcaggctaaggagtttatcgagagtaaggaagaaaaattcgacacccatctagcagaaggtggaagcaacctgtcaggcgggcaaaagcaacgtttgtccattgcacgtgctattgtcaaacagccggatatttacatttttgatgattctttctcagccttggattataagacggatgcgattttgaggagtcgtttgaaggaagtgacggaaaatgcgacggtgctaattgtggcccaacgtgtcggaaccattatggatgctgaccagattatcgtgctgaacgaaggtgaaatcgttggccgcggcacccacaatgaattgatggaaagcaatgagatttatcgagaaatcgccaattctcagcttaaccgtcaatcgttaacagaagaataggaggaattatgaagaatagatcagtatttacccgtgtttgggactatttgcgtcgttacaaatcttctgtatttttagctgtttttctaaagaccatcagtgcagttatgaatgccttggagccctttgtactggggcttatcattacagaattgaccaagaatctgttggatattgctaatggagtagaaggagcgcagattaactattcctacattgccatcatgcttgccatctatgcccttcgcgcccttctatatgaaatcggtgcctacggttctaactattttatgaccaaggcagtgcagggagcaactaaggaactacgtcaggatttgagtcacaaaattaacaaaattcctgtttcttactttgataagcaccagtatggtgatttactcggacgttttacaagcgatgtggagactgtttcaaacgccctgcaacaaagttttctccagctagtcaatgccgttctgaccctctctctagccattttcatgtgtttctggttggatgtatccctagcacttgtagtcgtaaccttggttccagtgacttattttggttctaagtttgtcatgggcaaatcccagccatatttcaagcagcaggctgatgccctaggtcgtttgaacggctttgtccaagaaaatctgactggttttaacgttctcaaactctacggccgtgaagaaatttctacagaagagtttcgccagattaccgcagatttgcaggaagttggtttcaaggctagtttcatgtctggtttgctcatgcccctggtacacggcttctcaaatatcgcctatgttgtcgtcgccctgctatctggattgaaagttcttgcaggtacattgacggtgggtaatatgcaggccttcgtccaatacgtctggcagatttctcagccagtccaaaccttgacccagttggcaccacagttacagtctgccaaatcttcccttgaacgcatcttttcagtcctagatgagcttgatgaagaagacgccaatgcgctggagttgacagctggtttgaccggacaagtcagctttgaacaggtcgaatttggctattcagaagacaagccgcttatccgtaactttaatcttgatgttaagccaggtgaaatggttgctatcgttggtccaacaggggcaggtaagacaacccttatcaacttgctcatgcgtttctatgatgtcacatcaggtgctatcaaggtagatgggcaggatattcaaaatctttcacgtcaatcctaccgtagtcaatttggtatggtcttgcaggatgcttggctctatgaagggaccatcaaggaaaacctacgttttggacgtctggatgcgacggatgaggaaattgtggaggctgctaaagctgccaacgttgaccactttatccgtaccctgcctggcggttataatatggaaatgaaccaggaatccagcaatatttcccaaggtcagaaacagcttttgaccattgcacgtgccttgttggcggatcctgctattctgattcttgacgaagcgacttcttcagttgatacccgtttggaactcttgattcaaaaggccatgaaacggttgatgaaagggcggacaagtttcgtcatcgctcatcgcttatctaccattcaggaagctgataagattttggtcttgaaagatggacagattatcgaacaaggtaaccatgaaagtcttttggcagacaaaggtttctattataatctttatcaaagccagtttagtgaatccaaataaaaaacgaactcccttgtcagtgacagggagttttctcatatacatgtttgtgaaaattaataggaaatttcggataatagtccctcagcggtagtggttgggaggatgcggacacgattgagagtcagtaatccgtcactagcagaagccaagccgttgttagtagtcacaccaagtttgtagccagcttgttcagttaaggctacggtatctgctgagtatcgtccaccagggtaggcgatagcgatggtttcctgatttaattggctgtcaagataggctttagaggaagtaagttcatttgtttgatcctcgatagaactatactctaaatcagggtggttgacggtatgcccttgaaaggagagccctgcggtctgcatttccttgatttgatcaagagtaaggtgccctgcttgtccatattcagtaaatcctgtaatgacattgttggttgctttcatttgatattgcttaagcaatgggtaggcataactataaaaatcccagaggctatcgtcaaaggttagccagacaacctttttgccagcaggaaggacattttctgtcaataccttataagcctcttcaggtgataaagtatagtaacctgcatcttgcaatgcttttagatgactttcgaaagtcgttggatctacgataagattcgcattagcttcttcctcaggagccattacgtgaatggcatgatacatgaggattggaagtttgataggttcagtttgttgttcccaaatgatttctgtttgtacttcactactttctgaagttataacacttgaagtggttgttgtctctaccgttgaagctttggaatcactttgttgcttagatggctgttttagaaagattagaaaaatagatagtagagtcactactaataatgcgatgccaagtagcattggcacaagttgtttcttttgtgtgcggcttcgacgggctcttcttgaatgtttcattatcttatctccataatcatatattaaaacaattatatcaaattttttgccaaatagtcagaatatttgttataatgggagaaatacattttaaaggagagcacatggtagttaagataggattattaggatttggaaccgttgcgagtggtgtgccatttttattagaagaaaatcaggaaaaaatagagaaagctgcgcatgatagtattgaagttgctaaggttttggtcaaggatgaagcagaaaaagaccgtctcttggctgcaggtcatgactatcattttgtaacaaatattgatgatattttagctgatgaggacattgccatcgtcgttgagctgatgggacgtattgagccagcaaaaacatttattacacatgccttggaagcaggcaagcatattgtaacagccaataaggatttacttgctgttcatggtagcgaattgcgtgccttggctgaagagaaaggtcttgcgctttattatgaagctgcagttgcaggtggtattccaatcttgcgtaccttggttaactcattggctgctgacaaggtgactcgtatcctcggtgtattgaatggtacttcaaacttcatgttgactaagatgattgatgaaggctggacttacgaaaaagctcttcaaacagcacaggaacttggctatgcagaatctgacccaacaaatgacgttgaggggattgatgcagcttacaaggctgttatcctcagtcaatttgctttcgggatgacagttgattttgaacacgtagcacacaagggtatttcgaatatcacaccagaagatgtagcagtggcacaagaattgggctatgtcatcaaacttgtgggtgatattcaagaaactacctctggtattgctgccgaagtatctccaaccttcctaccgaaaaatcatccacttgcaagcgtgaatggtgtgatgaatgctgtatttgtcgaatctatcggcatcggccagtctatgtactatggaccgggtgctgggcaaaaaccgactgcaacaagtgttatggctgacattattcgtatcgttcgtcgcttgaaagacaatactatcggcaaagcttttaacgaatatagccgcccacttcaattggcagccccaagcgatgtgaagagcgaatattatttctcaattgatgcgcctgataaaaatggaaaaatgcttcgtttagcagaaatcttcaattctgaagaaatttccttcaagcaaattctgcaacaagctgcagatggagaaacagcccgcctagtgattgtgacccatgaaatgagtaagactcagttggaaaatgtaacagacaaattgagtaaagaaacagactttactgtcttaaatacctttaaagtactgggagaataagcaatgaaaattattattccagcaacttcagctaatatcggtccaggatttgattcagtaggtgttgccctttcgaaatatctaacgattgaagtatttgaagagactgatgaatgggtgattgagcacaatcttgaacatgttccatcagacaagaacaatcttttgatcaagacagctttaaagattgaaaaaggattgcagccgcatcgtatcagaatgattagtgatattcccttggcacgtggtttgggttcatccagttccgttatcgtagctggtatcgaattggctaatcaattagcaggtttgaatatgacagcggatgaaaaattgctcaaagctacagaaattgaaggacatcctgataatgtagccccagcgattttcggtaatttagtcatctctagctatgttaataagagagtacaggcagttgtaacagaattcccagaagcaagttttgttgcctttattccaaactacccactgcgtacggttgaaagccgaggtgtactgccttctcagatggggtacaagaaagcagtggctgctagtgccattgcaaacgttgctgttgccagtttgatggcaggtgatctggaaaaagctgggaaagcaattcagtcagacatgttccatgaaccgtttcgtcagctacttgttaaggagttttgtccaatcaagcaaactgcacaggagttgggagcctatgcaacctacttatcaggtgccggtccaacagtgatggtattagcgcccaaagatagggaggacgctattgttctagcattagaggaactaaatctagacggaactgtccaccgccttcaagtagataccaaagggattgctattgtatagatagtgagaatctgtcatttgcaaaactaaacatgtttatttattggagttcgccatcgctactgtaagcggtagaaagggaactccttttttttgtgcattccattctccatttcaaaatattggggcaaattaatttggcttgtgaaagtatttttgttgaattttattcgttttctcctgtaatttttggtataataaatcctgtatatcttaaattgaaatgagaaggttatgaaagataaaattaggcttgaattagaaggcatcgatattcgattcgatgaacctttaaaagaatatacctatacaaaagtaggaggagctgttgattatctagcttttccgcggaatcgttacgagattgttcgtatagtagaatttgctaaacgcgaaggtattccatggcaagtattaggaaattcaagtaatatcattgtccgcgatggcggtattcgtggttttgttatccgtatggataaacttaactccgttactgtatcaggatacaccattgaagcagaagcaggtgccaatctgattgaaacaacaaaagtcgcacttttccattcgttatcaggatttgaatttgcttgtggtattccgggaagcattggtggtgctgtctatatgaatgcaggtgcttacggaggtgaagtggcacacattttagtttcagcgcagattttgactcctgcaggttatgtcgagacattggacaatcgtgagttacgatttggctaccgttcttctattttgcaggaaaacggtgcgattgttttgtctgcaaaatttgccctcaggccaggaaatcatacggttattcaacaagaaatggctcgtttgacacatttgcgcgagctcaagcaacctttggaatatccatcttgtggttcagtcttcaagcgtccacttggtcacttcgcaggacagttgattatggatgcgggtttaaaaggttatcgaattggtggagtcgaagtttctgaaaaacacgctggctttatggtcaatatagaaaatggtacagcatctgattacgaaaatttgattgcccatgtgattcaagttgttgaaaaatcttcaggaattactctggagagagaggttcgtattatcggcgatcctgctgatacactctagccatcaggctcttacaaaaaagaaggaatttatgagaattgaaaaagccaattattgaatttaagaacgtttcaaaagtatttgaagacagtggaacaactgtattaaaggatattagttttgaattggaagaggggaaattttatacccttttaggagcttctggttcaggtaaatcaacgattttgaatattattgctggtttattggatgctagttcaggtgatatttatctggacggtcaacggattaatgatgttccgaccaataaacgggatgtccatactgttttccagtcctatgcccttttcccacatatgactgtctttgaaaatgtggcttttcctcttaaattacgaaagattgacaaggctgaaattgaacgccgtgtgacagaagccttacaaatggtccgactttctggttatgaaaatcgttccattcagaaattgtctggtggtcaacgccagcgggttgctattgcacgtgcgattatcaaccagcctcgcgttgtcttgctagatgaaccactttctgccctggacttgaaactaagaacagaaatgcagtacgaactgcgtgaattgcaacaacgtctaggaattaccttcgtcttcgttacccatgaccaagaagaagctctggccatgagtgactggatttttgtcatgaatgaaggtgaaattgttcagtctgggacgccagtggacatttacgacgaaccaatcaaccattttgttgctaccttcatcggtgaatccaatatccttccaggtcgcatgatagaagactatctggttgagtttaacggcaaacgctttgaagctgtcgatggcggtatgcgtcctaatgaagaagttgaagtcgttatccgtccagaagatttgcagattaccctacctgaggaaggcaaattgcaggtaaaagtggatactcagctcttccgaggggttcactatgaaatcatcgcctatgacgacctcggtaatgagtggatgattcactcaactcgtaaggccattgtcggagaagtgattggactaagttttgagccagaagatattcatatcatgcgtctcaatgaaacagaggaagaattcgatgcccgtatcgaagaatatgtggaagtggaagaagtagaagatggcttgattaacgccattgaggaggaacgcaatgaagaaaacctctaggctttttgcaattccctatgccctatgggtctttctatttgtactcgctccagttgccttgattatcttcaaatctttctttgatattcatggcgatttcactttggccaattaccagacctattttaactcgccaaatatgacctatctgcgaatgagttttaactccattttttacgcaggtattattactctggtcacgcttttggtttcctacccaacagcctatttcttgaccaaactcaagcatagacagctctggctcatgttgattatcttgccaacctgggtcaatcttttgctgaaagcctatgcctttatcggtatttttggacaacacggctctatcaaccagttcctagaatttattggtctaggagctcagcaaattcttttcacagatttctcctttattgctgttgcagcctatattgagattccgtttatgattttgccgatctttaacgccttggatgatttggataaaaacctaatcaatgccagtcgtgatttgggggcaactccttggcagaccttcacaaaagttatttttcctctttctatgaatggtgtccgttctggtgtacaggcggttttcattccaagtctgagcctcttcatgttgacccgtttgattggcggcaaccgagtgatcacgcttggtacagctatcgaacaacactttctcacaacacaaaactggggaatgggttcaaccataggtgtggtcttgattttggccatgctcttgattatgtggatgacgaaagagaggaagaaataatgaagaaatttgcaaatatctacttaacagttgcctttctccttctctacttaccgattttctatcttattttttatgcctttaatgaaggcggagatatgaatggctttacaggctttaccttagagcatttttcatctatgcttggcgatagccgactaatgctgattctggctcaaaccttcttgttggccttcttgagttctttgattgcgaccattatcggaactttcggtgccatctatatctatcaggcaaaacctcgttttcaaaatgcactcttgtctgtcaataatatcttgatggtagctccagacgtcatgattggggcgagtttcctaattctctttaccatgattggtttccagcttggctttgtctcagtattgctcagtcatattgcttcttctattccaatcgtagtattgatggtcttgccacggctgaaagagatgaacgcagatatgatttcagcagcttatgatttgggggcaactcagccacaaatgctgaaagaaatcatgttgccatacctaacaccagccatcattgcaggctactttatggcctttacctattccttggatgactttgccgtgacattctttgttacgggaaatggttactcaaacctatctgtagagatttactcacgggctcgtcaagggatttctctagaaatcaatgccttgtcaaccctagttttccttttctctatcttattggtagtgggttattatttcatctcacgtgaaaaggaggccaactaatgaaacgattgtattcattttttgtaggaattatagcaattgtcctagttttatggggaattagttataagttagaagctgattcaacccaagggacaactgataaacttgtcatctataactggggcgattatattgacccagaattactcgcagaattcactgctgaaacaggtattcaggtagattatcagacctttgactccaacgaatcgatgtacacaaagattaagcagggtggaacaacatacgatttgacaatcccatctgagtacatgatttctaagatgacagaagaaaatatgttaatcaagctagataagtctaagattgaagggatagaaaatatcgatccacgatttatgggccttagctttgataagaataatgactattctattccatatttctggggaaccttgggcattgtttacaatgaaaccatggtagaaaatcctcctcaggaatgggaagacttgtggtcagaggaataccgtgacaatatcatgttaattgatggtgtgcgtgaagtcatgggctttggtctacaatcactgggctatagtctcaattctaacaatcctaccgagattgaaaaggcagccgaacatctttataatttaactccaaatgtcaaagcaattgttgctgatgagataaaaggttatatgatacaagatgcggcagcaattgctgtttctttctcaggtgaggcgagtgaaatgttagatggaaatgaaaatctgcgctatgttgtaccatcaaaaggttctaacctgtggtttgataacatggtcattccaaaaacagcaaaaaatattgatggagcttacgcctttatgagttttatgcttcgtcctgaaaatgcgcttcgcaatgcagaatatgttggctactcaacaccaattcctgcagccaaggctatgctggatgaggagactcagaacgacgaatccttctatccttcagaagaaacgatgaagaagatggaagtttatgataatcttggaccagagatgcttggaatgtataatgacctctatctccaattcaagatgtatcggaaatagtctgattggacaggtagcaatataaataaaagaatgggagtgaggttctttactaagtacttattgctcctattttttggtcatgcatactatagaaaggaagggaaatcccaatggaaaatcaccggaaagaagttagttttatttctcaatcaatcctctattcggttctgcgtggtagtttagttggcattgtcgctggtttagtggtcgttgcatttcgcttagccattgaaaaactattttctgtctttacgcacctctattctctggcaacagacaatgcaatctatttacttcttattggagggctttatctggtcatagctttacttgttggcaagttgatcaaagacgagccaaatgcaaaaggttctggtatacctcaggtggaggcagaactaaaaggaattatggatttgaactggtggtcagtcctttggagaaaatttatcggcggtgttttatccattgcatctggtctaatgctggggcgtgaaggtcccagtattcaattaggagctgtaacggctaaaggtgtatcagttcttcttaaatccagtgaaatggaaagaaggagtttgattgctagtggcgctgcggcaggtttggcagcagctttcaatgcaccaatagcaggccttttatttgttgtggaggaagtctatcatcagttttcacgtctggtatgggtctccgccctggcagccagtatcactgcgaactttatttccttacatgtttttggattaatgcctgttttgcatatgccgaaggacttacagttactatctcttgaccaatattggatctatatcttacttggagttttccttggccttgctggatatgtgtatgaaattgttatcctcaatatacaagatttctataccctcctctcaaaaatcattcctctcccagttccatactacagtgtatttgcctttttgtttattataccgattggttattttttccctaatctgttgggtggcgggcatcatttgattttagagcttccatatttggaacaaggactactgacattggcaatcttgattttaatacgatttgtatggagcatgatttcctatggttctggtctaccagggggcatctttttacccatattaaccttaggaagtctccttgggctttttgtcgcacggttcttccttgatattggtttcatcagtcaggagcagatgctattgtttattgtattgggaatggcaggctttttcgcagcgatttccaaagcacctctaactgctattattttagtaactgaaatggttggaagtttgaaccaattgatggtcatcgggttggtagctttgagttcctatgtgatgatggacctcttaggtggcgcgccagtctatgaagcaatgttggaaaaaattctgccagaagaagtagaacagcaagaacacatgaccttaatagaggttgttgtcaacgaaacattggacagaagatttgttagcgagttacgtttgccggattcatgcttgatcaccagtcaaattcatcacggtaagtcaaggattgtgaaaggaaatagccaactttctatgggggattccttgctcgttgcagttccaatctctcaaattcataccgttcgtaggatatttgagggagattagcattttttagattgtcttaacaaagagatgagaaaagtcccaatattatactgttttcgttgtctggtcaactccctcaattcttgaatggtttcatcgggaacgaaactccgaggaagcagaccaatccgtgttaatttggcaatccagtgagcgtccttcttgtcggttttctgacctggaatagccttcatgtgggctggttgagcaagtattagctcgaagtcatcacatagagcatgccagacaagtcgccaatagacacctgtgctttccataccaacagcttctacatgaaattgactgagaaaatcgtggtaagcacgtagacctttagtcgttgtatcaaatgtagctaagtaacgctttggacaagttgaggggaatacaaacgacaatatcgacttgatctacacatgattactatgacaattctttccttcttaaaattagagagcctatctactgaattttagtcatattcttgagcgcatattgtggttcttatcagtagggtggagcagttttgtcatcataattaacatcaataatgcaccaaccacaaggccctcactaggtatataatcttagtgagggctttatgctcattctcattattctgtgggtaaggacggagccatcatggatgtcttactcactccctttttagtgtgtattatctgtatctatggttatagatattattgatagctagttatagtttgaataaataactgaattttcagaatatacttgcaatgctgataattttatgttttaatatatttattggctttgccaataataaaggagaaaaactaggaggaaaagttatgaaaaagaaagaaactttctcacttcggaagtataaaattggaactgtgtctgttcttttgggtgcagtttttttgtttgcaggtgcaccatcggtagctgcagatgaattgacaagccttgtagagactaaggtggaagcaactgttcctgacgtaatcgtcagcgaatcagcctcagaaagtcccgttgtcgaggagttagttgacacttctgtggaggctaccccaactgatgtaaccactacagataatgtagaggaaacacttggctcagaagctcttgaaaacatcacaaatacagaagtagaagcgactcaaccagctgtagaaactccagctatttcagagaaaaaagtagaagaagaggagaagcttgccgtagcagatgagactactgctattactaatcaggaagaagcgaaaccacaaaacattgatagtaatacaatcattacagtacctaaagtttgggatagtggttacaagggcgaaggaacagtagttgcaatcatagattcaggtcttgacgttgaccacgatgtattgcatatttcagatctctcaaccgcaaaatataaatcagaaaaagagatagaagcagctaaagaagcagcaggaattacctacggcgaatggtttaacgataaggttgtatttggttataactatgttgatgtgaatactgtcttgaaagaagaagacaaacgttcacacggtatgcacgtaacgagtattgccacaggaaatccgacacaaccagtcgctggacaattaatgtatggtgtagctcctgaagcgcaagtcatgtttatgcgtgtattctcagacctcaaagctacaacaggcgcagcattgtacgtaaaggcgattgaagatgctgtaaaattaggtgcagatagcatcaacctcagcctgggaggagctaacggctctgttgttaaatgaatgaaaatgtgactgcagcaatcgaggctgctcgtcgtgcaggtgtttctgttgttattgctgctggtaatgatggaacatttggttcaggtcattctaatccgtcagccgattatccagattatggcttggtcggagctccttcaacagctcgcgatgcaatttctgtcgcttcttacaataacacaacggttggcagtaaagtaattaatatcattggcttagaaaataatgctgatttgaattacggtaagagttcgttcgataatccagagaaaagtcctgtatcatttgaaattgggaaggaatatgaatatgtctatgcaggaatcggtcaggcttcggattttgatggtttaaatttgattggaaaacttgcgcttattaaacgaggaaccatcagtttctcagaaaaaatagccaatgcaacagctgcaggggcagtaggggtcgttattttcaatagccgcccaggtgaagccaatgtgagcatgcaactggatgatacagctatcgcaattccatctatcttcattccattggaatttggtgaagctttggcatctaactcatataagattgcgttcaataacgaaacagatattcgccctaacccagaagcaggtcttctttcagatttttcaagttggggtctatcagcggatggcgagctaaaaccagacttagctgctccaggtggtgctatttatgcagccatcaatgataatgactatgccaacatgcagggaacaagtatggcttcaccacacgtagcaggagcagccgtactagtaaaacaatatttacaggcaacttaccctactaagtcccctcaagaaatcgaagccttagtaaaacacttgcttatgtctactgctaaagcacatgtgaacaaagaaacaacagcctacacttcccctcgccaacaaggtgcaggtatcatcgatactgcggcagctatttctacaggtttatatttgactggcgaagacggttatggcagcattaccttgggaaatgttgaggatatattcagctttacggtcacacttcataacattacaaacgaagataagactttaaactactcaacacagttaacaacggatactgttcaaaacggattgattaccttggctccgtgtctattagcagagattcctggcggtaaggtgactgtgaaagccaattcaagtacaactgttacaattaatgtcgatgcagcaagctttgcagaagaattgacaggtttaatgaaaaacggttactatcttgaaggttttgttcgatttacagatgtagccgatgtcggtgatattgtcagcattccatacgttggtttccgtggggaattccaaaatctagccgttctagaagagccgatttacaatcttattgccgatggtaaggggggcttctactttgaacctgttacagcacaaccagatactgttgacatcagccatcactacacaggtcttgttacaggaagtacggagttaatctattctacagacaaacgatctgactttgcgatcaagactctaggtacatttaaaaatgaagcaggatactttgttttagagctcgatgagtctggtaagcctcatttagctatctcgccaaatggggatgacaaccaagattcgctcgctttgaaaggtgtcttcttgagaaattatacggatttagtcgcaagcgtctatgctgcagatgataccgaacgaacaaatccactttgggaaagtcaaccacagtcaggcaataagaacttctatagtggtgatcctaaaaatccaaaatcaagcattatttaccctactgaatggaatgggacagacagcgagggaaatgctttagcagatggtaagtatcaatacgttttgacctactcatctgaagttccaggtgcagcagtacaaactatgattttcgacgttatcattgatagagaatcaccagttatcaccacagctacctatgatgaaacaaactttacatttaaccctcgtccagccattgaaaaaggagaatccggtctatatcgcgagcaagtattctaccttgtagcggatgcaagcggtgtgacaactattccttccttattagaaaatggtgatgtaaccgtttctgataacaaggtatttgtggcacaaaacgacgatggctcctttacattgcctcttgaccttgcagatatttcaaaattctactacacagtagaggattatgctggtaacatcagctatgaaaaagtagagaatctgatcagtatcggcaatgaaaaagggttggtaactgtcaatattcttgataaagatacaaatagtcctgtaccaatacttttctcttactcagtcaccgatgaaacaggcaagattgttgcagaattaccacgagatgccggcgatactagcgttcttaagctaccatttggtacttacacctttgatttattcttatatgatacagaatggtcaagcctagcaggtgaaaccaaagcagtcgtgacgatttcggaagaaaatagcactgccgaggtgaatttctatgtgactttgaaagataaggccaacttgctggtagatattgatgcattactaccttctggttcaaccatccaactggtaactgctgatggccagactattcagctaccaaatgctaaatattctaagaccgattatggtaaatttgtaccagttggtacctacactatccttccaaccctcccagaaggctatgaatttttggaagaattagacgtagcagtacttgcaaaccagtcaaatgttaagaaattaaccttgattaataaagttgctttgaaagaactgattgctgaacttgcgggacttgaagaaacagcgcgttattacaatgctagtccagaacttcaaactgcctatgctaaagcattagaagatgccaatgcagtatatgccaacaaacacaatcaggtacaagtagattcagcacttgccaatcttgtggcagcgagagagcagctaaacggtcaggctaccgataaggaaaaactaattgctgaagtatcaaactacacaccgactcaggcaaactttatttattacaatgctgaaaataccaaacaaattgcctatgatacagctgttcgttcagcacaacttgtattgaaccaagagaatgtaacacaggcagttgtcaaccaagcgttggcggacttgttagcggcgaaagccaacttagatggtcaaaagactgatatttcagcccttcgtagcgcagtatccgtttcttccgtattaaaagcgacagatgctaagtatctcaatgcatctgaaaacgtgaaacaagcttatgaccaggcagttgaagcagcgaaagcgattctagctgatgaatctgcaagccaagcaagtgtcgatcaagctctagccgttctgacaagcgcgcaggcagaactgaatggtattgctacttcaacaaatgatgccaaagagccagcaaatactgccactgacaaaaaagatgaaggcactgtaacgcctccacctatagactcagaaaaagttgatgtacaggcacctcctgtaaaagatactgggaattcagggcatgtatcgatcggtcagaagccaaaccctcaaccaactttacctcgtccagtcactttgcaagctagtctatctagccctaatcaagaaaaacaggtaactcaactaccaaatactggagacaatgatacgagatactatcttgttcttggtgtcattattgggctagggactctgttggtaagcaaacgacgtcataaagaagaagtctaagaaaatatagtcatactcttcgaaaatcaaaattatccgttgtcaacttgccatgatgaactccagttctatcttcggcttcgtttcctaggctacttttgatttgcattgagtatcattttctaccatttgtcaggctttaatcacgagtttgttatataaaagaccgcttaatcattgattaggcggttgtttgtgtttgaaattgaagcattgtcttttggatgtttcttgagacatcagttggctttacaagataataatcttgagccagttggtcggcaatataggagtggaggtaggttgctacaaggattctttcatatagttgaacaaggggaaattgtacagcaaatcctgcaatcatacctgcaagagtatctcccatacctcctgttgcttggtaaggaccaccagctcctattggggtgacttggtttggctgggtttttaggatttgagtagcggaacttttagctacaaggattgtattttcttgaaaagattgcaaggcttcaagatttctttggcttgtttggtcagcaaccggaatggctgataaccgttcccattctttctggtggggtgtcaggatgacttgtttacacgggaagttctttctgttttgctttgcgactaaggtaagggctgagccgtcaagaactaaaatctgctggtcagataaatgttcaaaaacaaagtccaataactgttcagctctgctattttccccaaaacctggaccaatcaataccaagtcagcattttctaagctacttatcagtaaggcttgatcgtcaaatgaaaatgccatggcttcaggcagatgactatgtaaggctggtatgttatctttttcagtagcaacagttaccaagcctgctccactgttgacgcttgctagtgcggccatgataatcgctccaccatagggatacagtccaccaatcagcaagactcgaccatagcttcccttatggctgttgcgtggtcttgcttgaatgacctttctacagagttcttgtaagtccatacatattcccccttttctttttattataccacgaggaatgaggtttatgacaatccagattttagataaatccaagttttcatgctataatgaattcatggtattatcaaaaaaacgtgcaagaaaagttattgaagaaatcatcgctctatatcctgatgctaagcctagcttggactttcgaaatcactttgagttggtatgtgcagtgctcttatctgctcaaactacagatgctgcggtaaataaggcaacacctggtttgttcgcagctttccctacgccccaagccatggcggcagcagaagtgaaggatattgagccttatatttctcgtttgggtttgtaccgaaacaaggcaaagtttttaaaagactgtgcccagcagttgatggaacggcataatggcattgtccctcaaactcgtgaggaattagaagccttggcaggagtgggaagaaaaacggccaatgttgtcttaagtgtcggtttcggaattcccgcctttgcagttgatacccacgtgggacggatttgtaaacaccacgatattgtcaaaaaatcagctacacccctggaaacagaaaaacgagtcatggaagtcttacctcctgaactctggctccctgctcatcaagctatgatttattttggtcgtgaggtttgccatcctaagaaccctgaatgcgaaaaattcccacaattatatgaatttgactaaaaaatcttctgtttttgaagatttttttagtttttatgtaaaattgtttgagtaaattctgaacatttttttaaattttataagaataataactcagaaaagaattatacgaatgttatattttataaacaagcctaaaaagtgatatatccgaatattgtttatataggtttcttttttattgacaaaacacaaacaataagctatactatatcttgtaataaggaaaaaatacgaaaaacaaaccgtttttctgttccaatgttaagaaaaagaggtagaagcatgttcaacgaaactccagtttttgactacgaagatattcagctcattccaaataaatgtatcatcaatagccgttccgaggcagatacaacagtgactcttgggaaatatagctttaaattaccagttgttccagctaatatgcagactattattgatgaagatgtggcagaaatgcttgccaaagatggttatttctacatcatgcatcgtttcgatgaagctggtcgtattccatttatcaaacgcatgcacgagcaaggtttgattgcttctatctctgttggtgtaaaagaatatgaatatgagtttgtgactagcttgaaagctgatgcccctgagtttatcaccattgatattgctcatggccatgcagaaagtgttatcaagatgattcaacatatcaagaaagaactgcctgagacatttgttattgcaggtaatgtcggtactccagaagcagttcgtgaactagaaaatgctggtgcagatgcgacaaaagttggtattggtccaggtaaagtatgtattacaaaggttaagactggttttggtacaggtggttggcagttggctgcccttcgttggtgcgcaaaagctgcccgcaaaccaattattgcggacggtggtattcgtacccacggagatattgccaaatccatccgcttcggtgcaagcatggtcatgattggttcgctctttgccggtcacattgaaagcccaggtaaaacaattgaagttgatggtgagaaattcaaagagtactacggttcagcatctgaataccaaaaaggtgcttataaaaacgtagaaggtaagaaaatcttactccctgccaaaggacatttaaaagatactctggttgaaatggagcaagatttgcagtcatctatttcttatgcaggaggacgtgacattaccagcttgaagcatgtggactatgttatcgtgaaaaactctatctggaatggtgactctatctagtcaaagaggacttgcaatgcaggtccttttcttgttacaatatttatataaaattgaaagagaataagtatgtaccaaacaagaaataacaaagagaagctctggctctttatcaaaatatttttgcccattttaatttaccaatttgctaattactccgcatcctttatcgataccatgatgactggtcagtatagtactatggatttggcaggtgtttccatggcaacaagtctttggaatccgcttttttcatttcttacagggattgtatctgcattggtctcgattattgcccaatatttgggacaaggagagaagtcaaagattcgacaagagtttcatcagtttgtctatctatctattggattaaccattttactcttgtgctcgatcctatttatcgctgttcccgtcttggctcagtttggacttgatgaatctgtttttcaagttggtcggcagtacctctattttatttccattggtatcctgcctctcttgctctttagtgtctgtcgctcttttttcgacgccctcggcttgactcagctatccatgtacctcatgttgctccttgtcccatttaacagtctatttaactatctcttaatttatgggaaaatgggcctcccggccctaggcggagctggagctggattgggtactgctttagcttactgggcggtattgctagtaatcgttattgtcatgtgcaaaaataagactatttcttcttatcagatttggcggtggagtccgattgatgggtctttactgaaagaaggactgaaaatcggtcttcccatcggtttacaagtctttgcagaagtagcaatttttgcagtagtagggctctacatggcaaaattttcagcacagattatagcagcccaccagtcagctatgaactttgcaaccttattatatgcctttccatatcggtatcctcagccctagctattgtcattgcttatgaagtaggcgctaaacgaccacaagatgtgaaagcctacagccgtctgggacgcttagtagcactaggctttgcaggtttgacgctaactttcctatattttttccgctccaaagttgcctacctttatggtaatgacgcagaatttatccgtctgacctcgcatttcctgagctttgccctcatgttccagttagcagatgcctttacagcacctattcaggggattttacgtggttacaaggatacgactgttccatttatacttggtttggttgcctattggtccatgaccttcccagtcgcattcttgcttgaaagatttttccaaatgggtccagaagcctattggatcggtcttatttcagggatttttgtctgcggaatagctctcaatttgcgcttgatcaaaatagctcattctcatttgtctgtgaaataaattaactatgaaagtcggaggcatccggctttttctctcttgtgaaaatatcttgctcatgttaaaataaaaggatagaaaatcaaatggagaaattatgaattattttaacgtaggaaagattgttaacacgcaaggcctacaaggggaaatgcgtgttttgtctgtgaccgattttgctgaagaacgttttaaaaaaggggcaaagcttgcactttttgatgacaaggatcagtttgccatggaagtggaaattgctagtcaccgtaaggctaagaactttgatattattaagtttaagggcatgtaccatatcaacgatattgaaaagtacaagggctttagtttgaaaattgccgaggaaaatttgaccgaccttgaagatggtgagttttattaccatgaaattatcggcttagatgtctatgagaatgatattctgatcggacaaatcaaggaaatcttgcagccaggtgccaatgatgtctgggtggtgaaacgaaaaggtaagaaagacctgctcttgccatatattccacctgttgtcttgaacattgatattccaaataaccgtgtcgatgtggaattgctcgagggcctagacgatgagaattgatattttgaccctcttccctgagatgtttgcacctctagaacactctattgtgggtaaggcgcgtgacaagggtttgctagaaatcaactaccacaatttccgagagaatgctgaaaaggctcgccatgtagacgatgaaccctatggcggaggacaaggtatgttgctccttgcccagccgatttttgataccatggatagcattgaacaaaccaagccacgtgttatcctattggatcccgctgggcgtactttcaatcaggcctatgccgaagaattggcacaggaagagcagctgattttcatttgcggtcactatgaaggatatgatgagcggattaagaccttagtaacagatgaaatttctctcggagattatgtcctgacaggtggagagttggcagctatgaccatgattgatgctaccgttcgcctgattccagaggttattggcaaggaagtcagtcatacggatgatagtttttcatcagggctattggaatatcctcaatacacccgaccatacgagtatcgtggaatggtagttccagatgtattaatgagcggtcaccatgaaaatattcgtaaatggcgtttggaagagagtctacgcaaaacctatcaacgtcgtccagacttgttagaaaactacaactttacagctgaagagttaactatttttgaaaaaatcaaagcagaagacacagttgattagactgtgtttttcttgctagaaggagaaatgatgaaacgcaaggtatttgaacattaccaaccttataaaatcaaacaaaaggcaagatttgatttaggaaataacgaaaatcgtatcattgattgggcttttttgccacaagagactttggaaaatttggatgtcaatcaattaagtttttatggtgataacacttactccgaactgattgagaaatatgcgacctatcttggagttaatcccaaacaagtgacggtaggtgtgggctctgatcaccttattcacatgattgtttccacctttatggaaaaggatgatacttttttgactgtcaatccagacttcttcatgtatgaaacctataatcacatgcatggtagccgttttgaagccattgatttagaagaaaaaaacgatacactcgtcctgccagtagagaaattgttggcgcgtgcggaggaggtgaaggcaaagataatcatgctttccaatcctaacaatccttcttcagtagcttattcactagaagatttggagaaattggctatttcttttaaagggctactcgttgtagatgaggcttacattgaatttgcaaatgtcgaaagcttcatcagtcgtctgcaacaatttgacaatgttttagttttacggactttatcaaaggcttttggacttgcaggtttacgagttggctttgcggtaggaagcgaagagttaatttatgaattggacaaggtcattcccccattcagcttgtcaaacttgactgcaaaaatggcagccgttgcattgaattatacagataaggttttagaaacagtggaagtaattcagaatttgcgagaagaaatgattttattcttgcaagggttagataactgtcaagttctacctagtcaggctagttttgtaacgtttaaagcaacgtgggcagaagaattttatcagcaagccttggcacaggattggaatttcaaatattatccaacaggtaaattagaagggcatattcgcctgtctatcggccgtccagaagaaatggacatgatgaaaaaaatgattgagaaactagtggaagcgtaaattctgctagtttttttgttttttgaaagaaaatgatagaaaatgattgacaatggcagaaaatcgtgtataatgatttttgtaaacggttgcaggaggtgttgaacatactcaaatcagaacgaaaacagattatattagagcgaatacactctcaacagtttgttcggctagaggaattaatcgaagttcttgatacatctgagtctactgtacgtagggatttggatgagttggaaaacgaaggtaagcttcgtcgtgtacacggcggtgctgaagcgccagggaatttgcaactcgaagagtctattctagaaaaatctgtcaaaaacgttcaagaaaaacgagagattgcggaaagtgctgctcgacaaattgttaacggagacgtaatttttttagatgcaggtacaacaaccggtgtactgattgattatcttcagcaggaaaatctgacagtcgttaccaattctattcaccacgcagtgaggctggttgaacgcaagataaaaacaatcattataggtggttttgttaagcaatcaacagatgcttccgttggagcagtagcattggaacaaattcgacagctcaattttgataaagcatttctggggatgaatggtattgataaaaactattttacaacgccagatattgaagaagcgaccatcaaatgcactatcatagacaatgccaaagaaagctatgttttggcagatgcttctaaaattggtcaattctcctttgttaaagttgcggcaatcgaaaaatccaacattatctgccaatcttcagaaagcagtttgttggacatcataaaagagaaaacgagggtaatcgaggtatgatttatacagttacgctcaatccagcgattgactatatcgttcgtttagaagatgtcgagacgggcagtgtcaatcgtatggagagcgacgataagtatgccggcggtaagggaattaacgttagccgtgttttgaagcgcttgggctatccgaatacagcaacgggtttccttgggggattcacaggtcagttcatcaaagatggattgattgccgaaggaattgatactgattttgttcaggttgatcaagatacacgtattaacgtgaaaatcaaagctgaccaagaaacagaaatcaacggtttgggtccgattgtgacagatacacagttggccgaattagaaatggtcttagcaggattgaccaaagaagacaccgttgtctttgctgggtctgctccagctagtcttggaaacgaagtctacaataggctgattcctgtggcgaaaaaagcaggagcgcaagttgtctgtgactttgaaggtcaaacactcctagactcactagcacaccagccacttttggtcaagccaaacaaccatgaacttgaagcaatcttcaacgtcgaattgaatggcattgcagacattgaaacctacgctaagaaaatcttagaaatgggtgctcagaatgtgatcatttccatggcaggggatggggctttgttggtcactccaccagctacttactttgctaaaccaatcaagggtacagtgaaaaactctgtcggagctggagattccatggtggcaggttttacaggtgaatacgttcgctcacaagacccaattgaagccctaaaatggggagttgcttgcggtacggcaacagccttttcagatgatttggcaagtatcgaatttattaaggaaacttatgaaaaagttgaggtagaaacactatgaaaattcaagacgttttgagaaaagatgtcatgttgcttgatttgcaagcgacaagcaaggaagcagttatcgatgaaatgattgctagtttggttgataaaggatatgttacagattttgatgttttcaaaacaggtatcatgaaccgtgaagcgcaaacaactactggtcttggcgacggtatcgcaatgccacatgctaagaatgcggctgtaaaagaggcaactgttctctttgcaaaatcaaacaagggagttgactacgcaagtcttgatggtcaaccaaccgatttgttcttcatgattgcagctccagaaggtgcaaacgatacacacttggctgcccttgctgaattgtctaaatacttgatgaagcctggatttgctgacaaacttcgtggtgtgtctagcccagaagaagtcatttcagtttttgacgcagctgaagcagcagataagactgctgaagaagttgttgcagcaccaagtggtgaccgtccatttatcgttgctgtgacagcatgtacaacaggtatcgcccacacttacatggcagaagaagcacttaagaaacaagctgctgagatgggtgttgacatcaaggttgaaaccaacggtgcttcaggtgttggaaacaaactaaccgctgaagacattaagaatgcagcaggtgttatcatcgcagcagataaggctgttgatatgcctcgcttcaatggcaaacctttggtatctcgtccagttgcagctggaatcaaacaaccagaagaattaattaaccttatcttggatggtaaagcatcagcctacactgcgtcagaaggagcagctactgtggaatcttcagaaaaactcagtcttggcaaagcgttctataaacacttgatgagtggtgtgtctcaaatgttgccattcgttatcggtggcggtatcttgattgcccttgccttcctattcgatggagctctaggtgtgccacaagacagccttggtagtcttggttcataccatgaaatcgcagctatgttcatgaagattggtggagcagccttcggcttcatgttgccacttctagcaggttatattgcttactcgattgctgaaaaaccaggtttggttgcaggtttcgtagctggtgcaattgctagtagcggtcttgcgttcggtaaaattccttacgcagctggtggtgaagaaacgcttgctcttgcaggtgtatcatctggtttcttgggtgcccttgttggtggtttccttgctggtggtgtagtgctcgttcttcgcaacgctttgcgcaaccttccaaaatcacttcaaggtttgaacgctatcttgctcttgccacttttgggaacagcaatcactggtttcttgatgttcttcgttaacatcccaatggcagcaatcaacacaggtatgaacaacttccttgcaggtcttgaaggtagctctgctattctccttggacttgtcctcggtggaatgatggcagtcgatatgggtggtccagtcaacaaggcagcttatgtcttcggtacaggtacacttgcagcaactgttgcagatggtggttctgttgccatggcagcggtaatggcaggtggtatggttccaccgttggcagtattcgttgcaacccttcttttcaaagacaaattcacacaagaagagcgtaactcaggtttgacaaacattgttatgggtctttcattcatcactgaaggtgcgattccatttggtgctgctgacccagctcgtgcaatcccaagctttatcgctggttctgcccttgcaggtgccttggttggtttgtcaggcatccaattgatggctcctcacggtggtatcttcgttatcgctttgacatctaatccattgctttacatcgcctatgttttgattggtgcggttgtatcaggtgtcctttacggagcacttcgtaaagctaaataattttgattgaaaccttgcttctggcaaggttttttagctatttcacgaggattatggtataatgtgagtattattgttattagaggagtcttgaaatggaaatcattcgcgataaagaatttgtcaatcagtatcattttgatgcccgcaatcacgcgtgggaaaaagagaacggaattccggaaacaaaattgaaagttgactttcaattgattgagcaaaatcgtgcagaaaatcgaacatctatgattaccattttgcgctttatgattgtactagatcattttgtgatttcaggtgccatgagtcaggccgttcacttaccaaatcgattggtagaagagccaactgaatttactgatgaggaaaaacgtgttttggtagagcctcttttggacattttaaaacgaatgacttatgaggttactgaaatcgcctttgatgcaccaggagtgaatttggagttttaatatgaaattagcggttataactgactcatcggctgttttgaatgttcaaagtattgagcgggatgacctgtttgtcctaagtattccagtcagcatcgatggggaaaattatatcgaaggacaaaatttgacggttgaagagttttatcaaaaaatggcttcatcgaaagaattacctaaaacaagtcaaccgagtttgatggaactagaagaaattctggctaaattaacagagaaaggctatacacacgcacttggcttattcttgtcatcaggtatttcaggtttttatcaaaatattcaatatttggctgatgaatttgaaggattaaccgttgcctttccagataccaaaatcacatcggctcctttaggtatgatggtcgaaaatgttctcaaatgggctgatgcaggacttagttttgaagagattactgggaaattggaccaagaaattgggaagactacagccttcatcatggttgatgacctcaatcatttggtaaaaggtggtcgcttgtccaatggtgcagccttgcttggcaatcttttgagcatcaaaccgattctgtattttacaggtgagggtaagatagaagtgtatgaaaaagttcggacggagaagaaggccattaaacgcctcttggaaatcctccaagaacaaacgaccgaaggacagtatcagattgctatcatacacgccaacgcacctcagaaggctgaaaactttaaacggcagttggaagaagcaggtgtcggtagcgatttaccaatcgtgtcatttggttcggtcatcggtacgcacttgggagaaggggcagtggcctttggtatttctcccattattgaataggagtttgcatgacaattaaggtaattatcgcaggattcaaaggaaaaatgggctcaacggctgttgagatggtcaaaggtgacgcagcacttagtctggctgccttggtagatccatttgcgacagaaacagaagtagacggtgttcctgttttcaagaccaaagaagaagttgccagtctggaagctgatgtctgggtggattttacaacgccaaaatttacctatgaaaacacccgttttgccttggaaaatggtttcgcacctgtggttggaacgacaggatttacccctgaagaaatcgaggaattgacagccttgtcagctgagaagggcttggggggcttgattgctcctaactttgctattggcgctatcttgctcatgcaatttgcagcacaggcagccaagtatttcccaaatcttgaaatcattgaattacaccacgataagaagaaggatgcaccgagtggtacggctgtcaaaacggccgaactcatttcacaagtccgtcagtcacagactcaaggtgcagcggatgaagaagaactgattgctggcgctcgcggtgcagcatttgacggtttccgtatccactcagtacgcttgccaggccttgttgcccatcaggaagtgatttttggggcacagggcgagggattgaccattcgtcatgactcttacgatcgtatttcctttatgggcggtgtcaatctcggcattaaagaggtagtcaaacgctcacaactcgtttatggtttggaacacttattatgaaattaaacaatctgccttctgagtttcaggaggctttgccgattttagagaaaattaaagcagctggcttcgaggcttactttgttggtggctccgtgcgggatgccattttaggcagacctattcacgatgtcgatattgcgacatccagctaccctcaggaaacgaaacaaatcttttcacggactattgatgtcggaattgaacacggtacggtgctagtattagaggggaaaaaggagtatgaaatcacgacttttcggacagaggaggagtatgtcgacttccgtaggccgagccaggtttcctttgtgcgttccttagaagaggatctcaaacgtcgcgacttcacagtcaatgcctttgccctggatgaagaggctcaaattgtagacctctttgatgggatgactgacttagaaaaccgcaccctacgggctgtaggcatcccggctgagcgtttcaacgaagatgccctccgtatcatgcgaggttttcgctttgcagcgaccttggactttgagattgaaccgacgacctttgaagctatggtgcaaaccgcaccgctcttggaaaaaatctcggtggaacgtagctttatcgagtttgataaactattgatggcggatttttggcgaaaaggcttgcgcgctatgattgattccaaggcttacaatttcttgcctgatttagctggaaaaagtgatgaattagaggccatgctaacaagtctgacagaagagtttcgcttttcgacatctgaacaagcttgggccctgctctttgtctgcctaggtattgataacatcaagtccttcctgaaaaaatggaaaaccagcaatgatttccaacgcagcgtggtcaagttggtagagatttatcagctccgccaagcaggacctgttaccaagcaaatctgtttcaagtatggcaaagaattcttatacttggtagaggaacttcatcaggcacaaggttttgttacagattttgcagcaatcgataagattgaccaagccttgactatccacgacaagcatgaaattgttgtcaatggaggacatctgatgaaggcatttgacctcaaaccaggtccagtattgggagaactactcaaagaggtggaattccagattgtggaaggacagctggaaaacgaagagcaagcgattatgacatttgtgaaaggaatcttagagaatgagtgattttatcgttgaacacctgactaaatctgtcggagataaaacggtctttgctgatctatctttcatcatccatcaaggcgaccgtatcgggattattggggtcaatggtacaggaaagacgactttgttggatgttctgtcaagtcgtatcggttttgacggagatgtatcaccttttcgtaccaaaaatgcttataaaatcgcctatctgacccaggaacctgattttgatgaaagcaagacagttttagacaccgttctttcatctgacctccgtgaaacccagctgattcgtgaatacgagctgctcttatctcattacgatgaaaccagtcaagcaagactggaaaaggtgatggctgagatggattctctcaatgcttgggagattgaaagccaggtcaagactgtcttgtcgaaactcgggctaacagacctcaacaaaaccgttgctgagttatcagggggtctacgtagacgagtccaattggcccaagtcctccttggcaatgctgacttgctcttgctggatgaaccgactaaccacctggacattgataccattgagtggttgacgactttcttgaaaaatactaaaaagtctgttctctttattacccacgatcgctatttcttggacaatgtggcgacacggatttttgaattggaccgcgccagcttaaccgaatatcagggaaattaccaggactatgttcgcttgaaggcagaacaggacgagcgagatgccgcccttcgccataagaaagagcggctctacaaacaagagctggcttggatgcgcagacaacctcaagctcgtgcaaccaagcagcaggctcgtatcaatcgtttccatgacctcaaaggcgatttagccaacaagatagacgatagcgaattggaaatcaattttgaaacctctcgtatcggtaaaaaggtcattaactttgaaaatgtcagcttttcctatcctgataagcccattttaaaagactttaacctgctcattcaaaacaaggactgcatcggtattgttggtgataatggaaaaggaaaatctaccctgctcaatctaatcgcaggcgacttacaagcagacagcggtaaggtagatattggtgaaaccatccgtatcggttatttttctcagaccatcaagggcttggacgaaagcaagcgggtcatcaatttcttgcaggaagtggcagaagaagctaagacgacatctggtatggtttctatcgcagaactcttggagcaattcctcttcccacgtaatacccatggtaccctgattgagaaattgtcaggtggggagaagaagcgactttatttgctgaagattctcttgcaacggcccaatgttctcttactagatgaaccgaccaacgacttggacatagcgactctgacagtcttggaacatttcttgcagggctttactggtccagtcattaccgttagtcacgaccgttatttcctagacaaggtagccaataaaatcttggctttcgaagatagcggtatagagactttctttggcaactacacagactatctggatgagaaggcctttctggcttccagctctgccatttccttggaaaaaccaaaggagaaaaccgagaaaatcaaagagaacaagaagcggatgtcctactttgagaagcaggaatgggcaaccatcgaagaggatattgctggcttggaggagcggattgcggcaatcgaggcggaaatgctgacctgtggtagtgattttacaaaattgtccgatttgcagaaggaattggatgagaaaaacgacctgctcttggaaaaatatgagcggtatgagtatctgagcaaactggagggctagatgaaagttcttgtcatgtcatatatggtcatctatctcttggtgaccttaggagcggctttgtttagctatctaaagaccaaaaaaatgaatacattgcgcttgattttaactatcctatccatgatattgctgacaagcaccttgtatttttatagtcagtcttatcacgacttgcagatggtggggtttgctctgggatttacctttatttctactctttttctctataatggaacgaaagaaggtagtaattttacgacagttatgctcttttccattggaaggtttatcttacatattcaatttttaattttgctctatctttttcgatagagcaattaatttttatccgtacaaatttttgaaaaggctttacgcaaacctttgcattgtgttataataaagaaaatacatttgaggtgatgattatgtctaaaaaaattatcggtattgaccttgggggaacttctgttaaattggccattttgactactgagggagaaattcaagaaaaatggtctatcaagacaaatattttagatgatggaagtcatattgttcctgatattattgacagtatcaagcagcgatttgaaacccatggtttgacaaaggacgatttcttaggaattggtatgggctcacccggtgtagtggatagtgaagctggcactgttatcggagcctataacctcaactggaagaccttgcaattggtcaaagagcagtttgaatctgcgctcggtttaccattctttattgacaatgatgcaaacgtagcggccctcggtgaacaatgggttggtgctggaaacaacaatccaaacgttgtctttatgacgcttggtacaggtgtcggtggcggtgtcatcgctgctggaaacttgattcgtggtgtcaaaggtgctggtggcgaattgggccatatcacagttgactttgatgagccatttgcatgtacttgtggtaagaaaggttgtctagaaacagttgcttcagcgacaggtattgtcaacctcagccgtcgctatgctgatcaatacgcaggcgatgcaaaactgaaacaaatgattgatgatgggcaagatgtaacggctaaagatgtctttgatttggcaaaagagggcgatgatttggctttgattgtctaccgtcacttctcagaatacttaggtgttgcttgtgcaaacattgctgcagtcctcaatcctgcctacatcgttcttggtggtggtgtatcagctgcgggagagttcttattggatggcgttcgcaaggtctttgctgaaaatagcttcccacaaatcaaggaaagtacacaaattgtcttggcaacacgtggtaatgatgcaggtgtattgggcgcagcatcactcgtcttgaaataatcgttaaaagcaggggaaactctgcttttttcaattccgctgtcacattttctttatatacatatattgaaaaatgtagtatttaagcatacaatgaaagtgtaaagagaaaggagtgtcaccttatgaaacaggtaaacatgtctaaaataatcaactatctgaccattcttggtttattgattttgttatctgcttttttccttgataactggattcgtgactggtttttcccgtctagctggggaaacgtagcaaccatgttgattctccctctactgggggctctaattcttatactatctatctattataaaaaattgtggactggtttgattagtatcttcttaataatctcatttcctctgatattcggtattggctactttatatttggcccctagaaggagtggttatgaacctgactttactaaaaagattaaatctagttttgtatggtatcgcaatttttctcttcgtcatgctatttttgccaataggacaatggtttgatattgtaaatgtgaattttaaactaacattttttatcattccatttttcggactagccagcttaccaacggctatttacactaaaaatgttcgtcagatattgttgagtgttctcttggttgccttgtattttatattgttcagcctaataactgccctatctggtttgttccaccttaatttttattcattctttttcaaatgagaactccggtgcaaaactggagttttttgctagaatttgctatactaagaccatgactaaagcagatattatttttaaagaaaacattcgtaagattatggaagagggcgttttttcagaaaatgctcgcccacgttacaaggatggaaatgtagctaattccaagtacgttacaggcgcctttgctgagtatgacttgtctaagggcgagtttcctattacaacacttagacctattccaattaagtcggccatcaaggaaattctctggatttaccaagaccagactaatgacctgtctgtcttacaggaaaaatacggtgtccagtattggaatgactgggaagttgaaggaacaggcacaatcggtgaacgctatggggctatcgtgaaaaagcatgacatcatttcaaaaatcctcaagcaattagaggaaaatccatggaaccgccgtaatgtgatttctttgtgggattatgaagcatttgaccaatccgcgggtcttttgccatgtgcctttcagaccctgtttgacgttcggcgagtggatggggagatttatctggatgcaactctaactcaacggtcaaatgatatgttggtagcccatcatatcaacgctatgcagtatgtagcccttcagatgatgatcgctaaacattttggctggaaggttgggaagtttttctatttcatcaacaatcttcacatctatgacaatcagtttgaacaggctgaagaattactccgtcgcacaccatctgaagttgagccacgtttggtcttaaatgttcctgacggtaccaatttctttgatattcgggcagaagattttgaattggtggactacaatccagttaaaccgcagttaaaattcgatttagcaatttaactggattagcagtgaagaacttcgttcttgctatttccaaccttcaacagtctatactcagactttcgaagccagttaaaccgcaacttaattttgacttagcgatttaagatgaggggggctttccagcaccagcgagattcacattctacgaatctcggaatcttccctatctctgaggagtcggtgatagtttcaacatgataaaaatttgcgcttggcctacttggtaagtgcatttttcatgtttttttgatagaatgataggacggaaagtgagagaaaatgactaaaaagattgttgccatttgggctcaagatgaaaatggattgattggaaaaggtgatagacttccttggtcattgccagctgacttagctcatttcaaaaaaacgacaacaggtcacacgatggtgatgggacgtataactttcgacggcatgggtaaacgtgctcttcccaatcgtcacaccatcgttttgacaacggataaaacctatcaactagagagtgaacgtattaccattttacacagtgtggaagatgttctagattggtataacaaacaggagcagacactatttgtgattggtgggggacaaatttttactgcttttgcaccttacattgaaacattaatagtgacagatattcacggtcaatttaatggcgatgtgtattttccgaaagcatttcctatggagaaatttcagctacaaagcgccaatttacgtccaaaagacgagaaaaacccgtatgattttacaataaaaacctatgaaagaagagatggttaggcatggagagaagtttattcggtttatttacagcatttctctgtgggatttgtgttctttgtgcgattcaagcctttcggaagaaacgttttggtttagcaattttatttttactgaatgcttttaccaatctggtcaatagtattcacgccatttatggatttttatttagataagagatatgaaagaggaaacacatggctgttaagcatacacatgagctaatctattgctcattttgcggaaaaaatcaagaagaagttaaaaaaattatcgcagggaacaatgtcttcatttgtaatgagtgcgtggaactagcacaggaaatcattcgtgaggaactggcagaagaagttttgacagacttggccgatacgccaaagccacaagaattactcaatatcctgaacaactacgtcatcggacaggatcgtgcaaaacgtgctttagcagtagccgtttacaaccactacaaacgtatcaatttccaagatagccgtgatgagaacgatgttgatttgcaaaaatcaaatatcctcatgattggcccgactggttcaggaaaaaccttcctagctcagaccttggctaaaagtttgaatgtcccgtttgctattgctgatgcgaccgctcttactgaggcaggttatgttggtgaagacgtagaaaatatcctcctcaaacttttgcaggctgcagactttaacatcgaccgtgcagaaagaggaattatctatgtagatgaaattgataagattgccaaaaaaggtgaaaatgtgtccattacccgcgatgtatctggtgaaggtgtccagcaagctctcctaaaaattatcgagggaactgtggccagcgtaccaccacaaggcggacgtaaacatccaaaccaagaaatgattcacgtggacaccaaaaatatcctgtttatcgttggcggtgcatttgatggtatcgaagaaatcgtcaaacagcgtctcggtgaaaaaatcatcggttttggtcataataatcgtgctattgatgaaaaagaatcatacatgcaacatatcattgcagacgatattcaaaaattcggtatcattccagagttgattggtcgcttgcctgtattcgcagctttggaccaattgacaacagaggatttggtacgcattttgacggaaccgaagaatgctcttgtaaaacaataccagacactcttgtcttatgatgacgtggagcttgactttgatgaggacgccttgttagcaattgcagaaaaagcaattgaacgtaaaactggtgctcgtggacttcgctctatcattgaagaaacgatgttggatgtcatgtttgaggtgccaggtcaagataacgttaaacgcgttcgtgtaacaaaagcagcagtagacggtaaagaaaagcctttactagaaactgcataaaaaaataaagggtggaaactgattgttttctacccttatttatgaaaggtataaaatggaaatcaacacacataatgctgagattttgctcagtgctgtttcaaaagcccagtatccgggctatgacattccagaaattgcccttgccgggcgatctaacgttggaaagtcctcatttatcaatactcttctaggaagaaaaaatcttgcacgtacgtcaggaaaaccaggaaagactcaacaactcaatttttataatatagatgataaaattcgatttgtagatgttccaggttatggctatgctaaagtatccaaaacggagcgcgctaagtggggcaaaatgattgaagagtatttgacgacacgagaaaatctacgtgttgtggtgagtttagtagacatgcgtcatgagccatcagcagatgatgttcaaatgtatgatttcttgaaatattatgaaattcctgttattattgtggcaacgaaggctgataaaatcccacgaggaaagtggaataagcacgaatcgatgattaaaaagaaattggattttgataaaaatgatcaattcgttatcttttcttctgagactcgtcacggatacgatcaggcatgggatgctatcttaagtaacatctaataaacagttcaggagaaaaatcatggaacgtactttcttcatcatcaaaccagatgctcttaagcgtggacttgcaggacaaattctttcacgtatcgaacgcaggggatttcaaatccgagatttaaaaatggttacagcgacagaagagctaatcagtcaacattatgaacagttgacagataaacctttcttcccgcaattagtacaatatatgacgagcgggccgatgatagctggcattatagaagggccagaaattatcaaatcttggcgagatatgatgggagctaccaatccagtaaacgccctacctgggactattcgtggagattttgcgacagcgcccgttgagggaattgtggcaaatgtcgttcatggctcagatagtgcagaagcagccgaacgcgagatcggtctttggctgggaaaatagcagagcagacacctagttttctaggtgtttttctttgataaattggtgaaaaaactgattagtggtataatgaaaaaaagcaataatagagaggttattcaccatggggcaaggaacaacgattagtcttatcaaagaagaaattattcaacaggaaaagcaaattgaaggtatatttttggagattgagaacttgcggattatgaagaagcagtgtaaaaattggttgttttttgctataacgatgctgttcttctctgtcattgtattcaaagggatgtttcttgttattatggtatttctttgtttcatgtatgtagtaacatcatatttccaatcggatagatgtgatggattaattagccattataaaaatgagattgattctatagaggaggctatcaataaaaatagagaattcattgctaagtacaaatatttttcgcatttttatgtagcaggtacgcaatatagggaagatcgttttgagccaatgagggtgttaagatgtctgacgtacggcggagaaactacagatgtcaagttagttcgtgagccagataataagtatgacccaaatgcagttaaagtacttgtatgtggttattttgttggctatatccctaaaactgcttctgaggaagtttcccgactaatcgatagaggggaaaagttgaacttgtcagtagatatggaaagacaagggagttatgataaaggttatcgtgcttattacgaactgacaatttacgttttaaatgatgaaaaattgtaattattaaattcattaaaaatatatcgagtttatgtgggacaagtaataaaatcagaaattaactctttgatatattaactggaatttatatatcgaaaattaatggctccatacctttaatcaaacaataattccttgtttcagtcttattttatgaccgactagaacttactttgggaatttactcgtaacaataacctatatttctaggtgtttttcttatggaaaattatcactaaatctgatataatgaggagtaatacccttgtagaggaagaaacatgaatttagaagatttgaaaaaacgacaggagaaaattcgtaatttctccattattgcccacatcgaccatggtaaatcaaccttggctgaccgtattcttgagaagacggaaacagtttccagccgtgaaatgcaagcccagttgctggatagtatggacttggaacgcgagcgtggtatcacaattaaactcaacgcaatcgaactcaactatacagctaaagatggagagacatacattttccacttgattgacacaccaggacacgtggattttacctatgaggtatcgcgttcgttggctgcctgtgaaggagcgattttagtggtggatgctgctcaagggattgaagcacagaccttggccaacgtttatctagccttggacaatgatttggaaatcttgccaatcattaacaagattgacctgccagcagcagacccagaacgtgttcgtcaggaaatcgaagatgtgattggtttggatgcttctgaagcagtgccaacatcagccaaggcaggtattggtatcgaggaaatcttggagcagattgtcgagaaggttccagcaccgactggtgatgtcgaagctccattgcaagccttgatttttgactcggtttacgatccgtatcgaggcgttatcctccaagttcgtatcgtcaatggtgtggtaaaacctggtgacaccattcagatgatgagcaatggtaagactttcgatgtgacggaagtggggattttcacacccaaagcaatcggtcgtgattatttggcgactggtgatgttggttacattgcagcctctatcaagaccgttgcagatacccgtgtcggtgatacggtaaccttggcagaaaatcctgccagcgagccactagcgggctacaagcagatgaatccaatggtctttgcaggtatctatccaatcgattccaacaagtacaatgacctccgtgaagccttggaaaaactccaactcaacgatgccagcttgcagtttgagccagaaacatcgcaggcactcggatttggtttccgttgtggattcttgggcctcttgcacatggatgttatccaagaacggattgagcgtgagtttaacattgacctcatcatgacagcaccgtcggtggtttaccatgtcaacatgacggacggtgaaatgattgatgtagccaacccatccgaattcccagacccaacaaagattgccactatcgaagagccttacgttaaggcacaaatcatggtaccacaggaatacgtcggtgcagtcatggaattggcccaacgcaaacgcggtgactttgtgactatggattacatcgatgataatcgtgtcaatgtcatctaccaaattccacttgcggagattgtttttgacttctttgataagcttaagtcgtccactcgtggttatgccagcttcgactatgagatttctgaataccgttcatccaagttggtgaaaatggatattctcctcaatggtgacaaggtcgatgccctcagctttatcgtccacaaggaatttgcctacgaacgtgggaaaattatcgtggacaaactcaagaaaatcattccccgtcaacagtttgaagtaccaatacaagcagctatcggtcagaaaattgttgcccgtagcgacatcaaggctcttcggaagaacgttttggccaagtgttatggtggtgacgtttcccgtaaacgcaaactcctagaaaagcaaaaagctggtaaaaaacggatgaaagccatcggctctgtcgaagttccacaagaagccttcctcagtgttctcagcatggatgaagacgataagaaataaacttgatacaaagaaacactcctgcattttcttgcaagagtgttttctcttatttacgtttcatttcaccttgtgggtagtaggtcccttcaggcatatcattgatgaagacatgaatggcttctttgggcgcattagtattgcgtgataccacctcagttacttcacgcgcaagggcaattttttgttcttctgtgcgtccttcaaacaaatcaatacgtacaaatggcatatatttcctcctttatttttcgtttattgtaccatagtttttatgattctccaaggatattttcataagatataacaaaatatatttatattttgttataataatatcgcgacaaacaataaggagaatgatttatgtttaagaaaaaagcaactcagatagttagcgaaacgtcaattaaaaaatctagaaaatttcttaatcggaaaacagcaggaataactggtggcgtcctacttacaacatttatcggttcacaattaatgactgctgaacttccaaaaaaagatgacctttatggacaacagtatgtaacagtcgtaaaacatcttcaggaagcaggtttaaaaaatattcagggggtggaaatcactgatttagaatttggaaaaataggtgaaagcaatcttgtcgaactcgtctctgttgacggagaagattggaaggaaggacgtactttaaaaaacatcccaattacaatctcctaccatgttcccaaaaaagatgccgttgaattcaacctaccagcttctaaaaatttagcagatgtcgagaaagagctgaaagattcaggttttatgcaaatcgaactaactcctgttctgctagtagaagaaggcaatgcggacaaaaaagataaaattgatcgccttcaaatcggaaatcacacctatcaatccaatcatttttactctactagtctccctgttacattaacctattttgacgttagcaaagataacatcaaactaccagaaaatctagcagaggctaaaacaaaaccagagctcgaaaaacaactaaaaacagcaggatttacagacatcaagtggactgctgttgcagacaaggataaagcaaagcacgaaaaaattcaaaaaattaatctaggtggtgcagagattcaattgcccaccaaacaggagattatcagcaaaaaatcaacccccattgtaattacctactacgatttctctagcttcgctgaactgccatcatccatttcaacgaaaacagctgcagatactaaaaaattgtttaccgacggtggtttttctcaagtatctgaagtagcaacagagaccaatgaaattgctaaaaacggacaaatcattgcggtcgagattgatggaaaatcttttaacgagatgaacgataaggtcatcaaaaaagatagcaaagtcattgtcaaatattggaatgctgaaaaagctattgctgagaaagcacgtaaagaggaggaagaacgtctcgccgccgaagcgcaaaaagtagcagaagcacaaagccaagttcagcaatttactgctacaccatctcaaaacacatattatccaaattgtaaggcagttagacaagcaggagctgcaccaatctatcatggagaaccaggttacggtagtcatttagaccgtgatggagatggagttgggtgtgagtaagaaaaaacattgacaacgtttacattgcgtgctatactactcttataaggagggattgctcatgacctataaataccgtatgattttatcgttcctactcactggattatttttgtatctagtagtaactgtttttaacaaaagtgtatgggaaggcccattgtttcttgcattttctttttacagcctgatatatggttgtgttatgctctacaagtggaaaccaacggcagctaaaatcattttccgatgtattggagaatttctctctttaccatggtcttaatatcaaacaagctcaaaacgggcttgtttttctatttcctaaatggtcaatttatgatagaatggagggagtgaaaatttaagattggaaagagaaaagtggctcaattatattataaatatgggacaatgaactcaggaaaaaccattgagattttgaaggttgcccacaactatgaagaacaaggaaaacctgttgttatcatgacatctgcacttgatactcgtgatgcctttggtgttgtatccagtcgtataggcatgagaagagatgcagtggcgattgacgatgatatggatatctttggttttattgaaaaaatggaaccgcgtccttactgtgttctcattgatgaagcacaatttcttcgacgtcatcacgtctacgcacttgctcgcgtagtcgatgaattagatgtacccgttatggctttcggtcttaaaaatgatttccgaaatgaactatttgaaggttcccaacatttgctcttattggctgataaattagatgaaatcaaaacaatctgccaatattgttctaaaaaagcgacaatggttttgagaacacaggatggaaaacctacttatgaaggagaacaaatccaaattggtggcaatgaaacctacattcctgtctgtcgcaaacattatttttcaccagaaattaaagatttaccctaatttttgaaaatgaaatgagaagcaactgtaaactgagcaactatatagaactgaatttgcctatgactctgtgccaattttcataacttacatactacggcaaaggaattgaacacgccctacaagctgtgtcaaaaagataatttctccaagtgtttgtaacacttggtcaaaattcctattttgactgtgcttgcttaacgggctttgtatcttaatggaattgaacacgccctacaagctaactagaagtgtgtgcggtcaaatatttagaaaggaattgaatacgggctacgaactgtgcctgtttcatgacctacatattacagaaaggaattgaacacgccctacaagctgtgtcaaaaagataatttctccgagtgtttgtaacacttggtcgaaattcctattttgactgtgcttgcttaacgggctttgtatcttaatcttatgaacatctacgatcaattacaggcggtggaagaccgctacgaggaacttggtgaattgttgtctgaccctgatgtagtcagcgataccaagcgttttatggagttgtctaaggaagaagctacaactcgtgatacagtaacagcctaccgcgaatataagactgtacttcaaaacattgtcgatgcagaagagatgattaaagaatcttctggtgatgctgacttggaggaaatggctaaggaagaactcaaacaagctaaggctgataaagaagcttacgaagaaaagctgaaaatccttcttttaccaaaagaccctaacgatgacaaaaacatcatcttggaaatccgtggtgccgcaggtggtgatgaagctgccctctttgctggagaccttttgaccatgtatcaaaaatatgcagaaggtcaaggctggcgttttgaggttatggaggcttcatataacggtgtcggcggtatcaaggaagtggttgccatggtctctggtcaatccgtttattcaaaactcaagtatgaatcaggagctcaccgtgtccaacgtgtccctgtgacagaaagccaaggtcgtgtccacacctcgacagcaactgtcctcatcatgccagaagttgaagaagtggaatacgacatcgatccaaaagatcttcgtgtcgatatttaccacgcatctggtgctggtggacagaacgtcaataaggttgcgactgccgttcgtatcgttcacttgccaaccaacatcaaggtcgaaatgcaggaagaacggactcagcagaaaaaccgtgaaaaggccatgaagattatccgtgcccgtgttgcggatcactttgcacagattgcccaagatgagcaggatgctgagcgtaaatcaactatcggtacaggtgaccgctcagagcgcatccgtacatacaacttcccacaaaaccgtgtgacagaccaccgtatcggcttaaccttgcaaaagctggatactatcttgtcaggtaagatggacgaagtcgtagatgcccttgttctctacgatcaaacgcaaaaactagaagagcttaacaaataatgaattacgctcaattatttgcagcatacgaagaacaattagtcgcaatcggtgaagaggcagaatccctgtccttcacctttcgtggcttaaagggattgaactttacggaatttctcctcctgctccgtcaggaagtcacaccgactgacaaagaagagattgatgcgatttttcagcaactttcccaacaccgacctgcccagtacattatcggcaaagctgattttcatggcttggagtttgcggtggatgagcgagtcttgattccaagacctgaaacggaagaattagttgatttgattttgcaggaaaatagcggagcaagtttgcgtatcttagacatcggtacaggaagcggtgccatagctatttcccttgcaaaagctagacctgattgggaagtggtagcggttgacatttcaaatgatgccctagcagtggctcaggaaaatgcaagaaccaaccaagtctctgttcactttctagaatcggatgtcttgcaagctgtgacagggaaatttgacatcattgtttctaatccgccctatatctcaccagatgacacagatgaagttggactcaatgtattgacttctgagcctcatcttgccttatttgcggaagaagatggcatggctatctatagacaaattgcggagcaagcaggggcatttttgaaggaaaatggaaaactctactttgaaattggctacaagcaagggcaagacctaaccgacttactcgctctgcatttcccccaaaagcaaattcgagtcctcaaagaccaatttggacaggatagaaaggtcgtagcggatgacaatggataaactccgaacaattcttgaaaatggtggtgctgttatccttccaactgaaacagtctatgggctttttgcccaagccttgaatgaagatgcagtcaatcgtgtctatcagttgaaacagcgtccgcgggacaaggcaatgaacttaaatgtctcaaatctgaacgatatttattttttcagtcaaaatacacccttttttctggagaaactgtataatagatttatgccaggaccgctaacgattatcctgaaagcaaacgacaacgttcctttttgggttaattctggactggatactgttggttttcgtcttcctaatcacgaacaaaccttacgtttgatttcagagactggcccacttattggaccgtccgccaatatttcaggaaacgaaagtggcaagaagttttcggacatccaggcacaattttcagttgatttgcctggcattgaggatgaccaagctctaacaggcattgattcaacgattttggacctttctggacagaaagcgcggattttgcgccaaggtgctatcagccgcgaagagattcagaaagccattcccgaaatagaatttgaggtagttttatgattcgtcccattgagaaaagtgacttgatagtcatccgagaaatcaatgctcaatccttagggtatgattgttcattggaacaaactgagcgacagttttttagatgcacgagcacattggggcatatcttgttggtctatatagatgacataagtggcgcagtgcaaggttacattcacgcacaagtctatgaaagtctctattcggatacaggcctcaatattctcggactagctgttttgcctggtcatcaaggacaagggattggagcaagcctgctgaaagccgttgagcaaattgcacagaaagagggctaccattttattcgcctcaattctgctgaaagtcgtctccaagcccatcttttctacgaaaagaatggctatcactccgataaaatgcagaagcgttttatcaagcacatttagcccaatacaaaggagtaccgtatatgatttttgacaaagttaactacaaagaatttgataaagaagtttgggaagctatccaagctgaagaaaaacgccaacaaaataatatcgaattgattgcgtctgaaaacgttgtttctaaagctgttatggcagctcaaggttctattttgaccaataaatacgcagaaggttacccaggtcgtcgttactatggcggtacggaatgcgttgacgtagttgaaagtttagctattgaacgtgctaaagaaatattcggtgcaaaatttgctaacgttcagccgcactcaggaagccaggccaattgtgctgcctacatggccttgattgagccaggagacactgttatggggatggacttagctgcaggtggtcacttgactcacggtgcatcagttagcttctcaggacaaacttacaactttgtagcttacaatgttgacgaagaaactggcttgcttgattacgatgcaattttaaaacaagcaaaagaagtacagccaaaattgattgtagcaggtgcttcagcctatgcccgtacaattgactttgctaaattccgcgaaattgcagatgcagtgggggccaaactgatggtggatatggctcatattgctggtcttgtagcagcaggtcttcatccgaacccagtgccacatgcccatattacaacaactacgactcataaaactcttcgtgggccacgtggtggtttaattttgaccaatgatgaagagctcatcaagaaaatcaactcagccatcttcccaggcatccaaggtggtccattagagcatgtcattgctgcaaaagccgtatctttcaaagaagttttggacccagctttcaaagactatgctcagaaagtgattgagaacagcaaggccatggccgaagtcttccttgcaaaccctaactttaaagtcatcacaggaggaacagacaaccatctcttcctcgttgacgtgaccaaagttgttgaaaatggtaaagttgctcagcatctcttggatgaagtaaatattactctcaataaaaactcaattccttacgaaaaactctcaccattcaaaacaagcggtatccgtattggctctgcggccattactgctcgtggttttggagtagaggaagctcgcaaggttgcacaactaactatcaaagcacttgaaaatgcagaaaatgaaaaagctcttgaggaagtccgtcaagaagtgcgtgctttgacagatcaattcccactttacgaaggtttataatggatatatttgtaaaaaaagccatcatacatcaatttagtcctgatgatacagagctggtcctttccgaccagcttttgactgttagcccaaaaatagaagaatatttgcgtaaaaagattgaacgtgtcttttctgatgaagcaaaaacaggacaatttaaccccgacaatccttttcttgactatttagatggcgacctactgaccaactctgtcaagattgctaatctatggaaagaagaattttcaatttctgagaatttaaaaaccaatgacctcattttcatagagtttgaacgaaatggtgttgaacattttgcctttttgagaatctcactgcgtgaaaatctcgcccacgttggtctggaaagcggaagtcctttaaaaatcacccagaataatttacctggagcaggttcagcacctgatgaagccttgattgtcaatcttcaaacgcggaagtatcatttgattgagaaaagaatcaaacacaatggagccttcctcaattatttctcagataatcttctgcaagttacaccagctatttctgcaaaaaaatcaatcaaagcagtagagcaaactgcacagaagattgctgacaatttccatcaaggcgattttcaatttcaatcgaaagtcaagtcagctattttcaacaatttggaagaagataatgagctttcacctgaaaaattggctgatcagttattcgataacaacctgaccgctcgtttaaatttcgtcgatcaactgaaagaggtcatacctgataagatttccttcgatgaaattgatagtagccgtcaacttaagaaatttgaaaatcagaagctatctttatcaaacggaattgagttgattgtgccaaatgcaatctatgaggatgcagaatcggttgagtttattcaaaatgacaacgggacctattctattcttatcaaaaatattgaagacataaagagcaagtaaatgaaaaaactgatacgtacgctgatacttcttttgctgatttttctcggttacaaattctatcaaacctacaatgcagtcaagcaagtgatgacctatcaaactatggtacaagaagtattggctgaaaacgacacaccagctaatgaagaactagtcctagcaatgatttacacagaaaccaagggacaagaagcagatgtcatgcaatcgagtgagtccgctactggctatgctaacactatcacggatagtagagagagtatcaggcaaggaattatctacctgacagaaaacctacggttggctgaggaaaaaggagtagaggtttggacagcagttcaggcatataatttcggtccagcctatattgactatattgctgaacatggtggagaacatacactctctttagctaaagaatactccagaacagtagtagcaccaagcttagggaatactacagaagaaacatatacctattttcatcccttggctttgctaaatggtgggaagttatatgtaaatggtggaaatatctactatgctagacaggttcgttttaatatgcacctgatgcgcctcattaatttattttaatacctatcaaactcatcggaaatctgatgagtttttaactacagcatttttacaaactaggtaaaattgtagtataataaagagaataggagacagagtgatgaaacgaaatgtattgattacaggtgcaagtagtggtattggcaaagcaatcgcttatgtgtttgctgctaatggtgataatatcatcattacaggacgaagattggacaaactagaagaaattaagcaagatattgaaaagcaataccatgttcaggtgtcagttcattcatttgatgttacgaatatggaacaaacgattgtaaattgtcaaaaaattttagaagaagttggtcaaattcatattttggtaaacaatgctggcctggcattgggattggacaaattccaagactatgatttgactgacatgatgacaatgattgataccaatattaaaggattactaactgtgacacgtcagttattgccacaaatggttgaaaataatgagggtcatattatcaatattggatcaacggccggtatttacgcctatgcaggagctgctgtctatgctgcaaccaaatcagctgtcaaagtgctttcagacgggatccgtattgacacgattgataaaaatatcaaggtaactacgttacaacccggtatcgttgagactgattttagccaagtccgttttcatggagataaagagagagcagcgacagtctatcaaggaattgatgctcttcaagcaaatgatattgccagctgtactctatttgttgcaaatcaacctgcacatgtgcagatttctgatatgaccattatggcaaccaaacaggcaactggctttactattcatagagattagaggggagatagctagaatgaaaagaaaatatttagcactcgctcttggcttgctcactatcatgtcgctttctgcctgtcaaactgaaaagaagggcagttccgcaagtacctcaactgctgatacccaggtttctaatgccaatacaagcaggtcatcaacaatccaacgtgagatttctcttagttctatggatatagatgctctaatgcaaggcaattacgatagtatactaggcacctggcaaaatagccaaggaaattcactagtcttcaatagcaaaggattagtagcagatagccagtccttacttggccgcggaaaaataactgacggaatttttgaaacaggctatgtagacgcaacgattggcgatgtaacactattaatgattcccaaaggaacacaagcaaatacaactgagacagacactactgactctacgcgcgatagaatgattgtaataagccaagaaacaacagcagacgtggtagatgtctattatcgcttgaccaattcagccactagcggtatagacccattaaaaaatactgaaacaggcgtccagttggatagtggaccaaaaacgattgattatgccaactcaattttaggcgaaaacaattggcgcgtcattgaaggtaactacacgcgcaccgaatctattccttataatattttggaaggcgatgataatgcccgttacactatttaccaaaacggtgttattatcaatgcagattatcaaattgtttatcaaccataatgattctctaggaggttagatgtgacattcacatcatttgaaccaacacgcaatgtgcaagattttcatttggcagcatttgcctactatgatggactagatgtaatcgaccaactcaagccaggaacacctgttcagctagtcggagaaccttcaaacccacatgactcagaagctgtagcaatcttttatcagggcacaaagttaggatatatcccatcggataaaaactcactaatcagtcgcttaatctattttggacacggcgatattctagaggcacgtattcagatgtccaatacagaaaatcatcctgatcgccagtttcgagtcgttgtaaaactaaaagataatcgtaaaaatgatagtcggtaatttaccaacctacccattttctacttaacacggagctgtgctctctgtttttgttcttcaataatgcttaaaaaggctgcaaactccctatctaggcgatgttggtaggccttattttttattgtgagatcttccaggaacactggataggttccttttttatacaattctccttgaaagaagaagcggtccgataatttatcaactgaaacaagagaagaacgccagcggcttttacgagaatgagaaggtttccaagatatttttaattgcttctcataaaagtaccagcccataatatagattttagtaatctgatttcgttttctgtcttgatagaaacaaggaactgcataaacatttccatgctttgtttgcaaaaaaggatggaaatcttttatcttttcgtattctttctttggaataagggttaattgattatccttaataaccttcttttcatcaatagtatatgaataacggtaggggtcataaatggttgattgtccacgcgctctataacgctctgccatttccttaaaaataggtagacgtctataaccatccatcagactagatagactaagccctcgtcgattattatttttcttcacaccaagaatctggcaggtagaccaataattgataggaatggctcctaatcctaccagaagaccggcgctgtcaaaatgactggcaaagcgtacctcacgagtgtgaccagtctcatttttcaaatcaacaaatacaggttgcttgtcctgttcaaaaacaattatataatttccagaagactccgtattttctctaattggaacggtgtagaagtggtgaaaatttggtaattctagtaactttccaagtgttgatgttttcataacacaagtataacaaaaaatatttttcaaatccacaaaaatgtttaattcgttaaacatagatataaagaagctgggaaagacatccatgacgactttcccactcccaccgtttattcaaggataggtgatgattgtcttatctaccgaatcttctaaagcctggcgcgattcttctgataaacgcaaatccgcaagggtttgttctgaaaaatagtagggatttagactatctacaaatgcagaaattgaaatgacagctttctccaatatcagagatttttcagtgtaagcaaagggaatagcagaccaatcatcactctcgaacatttctaaaatatctttttgaacttgaatttcagcctcatttttagctgaaactaggattgtttttagtgtagcacgaaaactttccttgtcttgcaccaagtcttccaaggtcaacaagctttcatctgccttctcatagaaaatatctaattccgtctctgacgaagtagtcacatggagccagtcagccttgatactggttttcattactgcataggcagaagcattttcaaagggactgctgcgcgtttgaggatagagaacaatccactctttctggaatagattgtcaggtttagctattttcagttcctcctcagaagctgtaccaatccgctggctgatagcagtagtgtcatcttgctgaaagaatccaatgatacgcggattttgcggaccgccaatggcatcaatttttgttcccagatcattaataatgcgtatgttcaaggcatgacactgctcatttaatagtctattttgctcttttccgagccagtagattccaatacaagatagaccagtagcaataagcaagacaagtaacagcactttcgagtatttcagcacagccatcacacctttctaaaacgctttcagtcatatattatcatatataaatatcaaaagaaactattttaaggtaccacattaaactgttacacaagtatataaattctaagtttacgacaggaatgtttaatgataaaatataggtaaattcgaactcataatttaataggtgtagatacaacaccgttggaggatactatggatgaacaaaatcaattcaattgggtaaacttttataaggaatttgcttggaaattagtagactataaagataatagagcagagctggttgagaaagtaaaagctatctataccaaaacaaagatacatatgcccacgttagaaaaggacaatcgactgatagatattgatccttttacgatatttggactcttcaataagcaaataaaagaggagaatcgcattaaaattctgacagctatagcagaattattcaacctccaaacggaaatcccatcctcttttgaaagtataccagtactgatgaatcagaatgcgactttctattattttatcggagatcgtgatgagaatgatattgatgacttatgggaacttttcattgctgctttgacctatagcaaggagcctacggctgagaagaaagaaaaattttcacactattttgatttggctataaacaagaaaggaaatggcaacagcaagattacgatggccttgtattggattgctcccgactttttcttgagcttagatagtcaaaatgaagcgtatgtgtatgagtctggggagattccaactgacattgtccaaaaattaccaaagatgaagtcaaaaatttctgccgatgattatttttatatctcggactctatgcatcattatttaaacagtgcagagagcaaactgaaagattttaaagaattatcatccatggcttggaaatactctaaacagatcaatcaagaagagaaggaaagaagtgctggaacaatttctccactggctgatgaaactgatactggaaacgagataggtagtgaagaggtagtagaagatagctatacgaaaaatcacttcctatcagaagtctatatgacagaagaagagtatgatcaattaacctccatactccaaatgaaaaagaatatcatcttacaaggagcgccaggagttggaaagacgtttattgcagaacgcctagcattttcattaatgggtaaaccagatttagaaagggtcatgacaattcagtttcaccaaagctattcctacgaggacttcatcatgggctttaggccttcgacaagtggctttgagctgagaagaggggcattctatactttctgcaaaaaagcagagtctgacaagagtcataattatttctttattattgatgaaataaacaggggaaatttgagcaaaatttttggtgaattgtttatgctgatagaaaatgacaaacgaggcaagtctttacagctcctctactcggatgagcaattctcaattccagaaaatctatatatcatcggtatgatgaataccgcagataggagtttggccctacttgattatgcactgagacgacgctttgccttctttgacatcaagccaggtttttcaactacgggattcaaagattatcaagcaaatctgaaaaacgaaaaattcgatagactcatttcctgtgtagaaaagctaaatcaggccatttcaacagaggaagtactgggagatagcttctgtattgggcatagttacttctgcggtttatcggcagaagtactggaacaaggtttgctagaagccattgttgaatatgaactgattcccctcttgaaagaatattggtttgatgaaccgacaaaaatttatgattggagtagtaagttaaggagtgccatccagtgatacctgtccaaaatatctactatatgctatcctacgcattcaaaatccttcatgagcaggaatataaacggatcgctactgaagaatttaaaaatgctgcagatctactggcggaaataatgataatcagcctctcgatacaggtgaaaagaggacttggtcgagagtatcgttctcaaaccgagtcactctcggcacttaaaggtaaaataaatatctctgaatctttaacacctccgaattggcgtagaaagcaacttgtttgccaatacgatgatttttctcttgacagtagaatgaatcgcattatcaaagcaagcattgagatactgctaaaagctgatataagcagggacaggaaaaagaaattgagaaaactcttagttttctttggagaagtctcaaaaattaatctacactcaatcaattggaatttacaatacaatcgaaacaatcaatcgtatcaattactaatgtcaatctgctatttggtggtgaatggattaattcatacagagagggaggggaataagaaattgatgaattttcttgatgagcggagggaatccttgctatatgagaagttcattcttggatattataaaaagcattatccccaaatacaggttaccgcctctcagataccttgggcactagatgatggttttggagaaatgctccccatcatgcagagtgatatttacctcaaatataaagatactatattgattattgatgctaaatattattctagtaacacacagattcgctttgataagcgcacactccattcaaataatctataccaaatttttacctatgtgaaaaaccaggcttatcgcctgtcagattcaaacgatacagtagcaggaatgcttctatacgctaaaaccgatatagatattcaacctaatcaggtctaccaaatgcatggaaaccggattagtgtcaaaaatttggacttaaacctgccgtttgcaagtattgctgaacaactggatgacatcattacatcgcattttgcatcccctccaaaactgtactagttagagctctaagctagaaaacaaaaaaacaatcaaagtagtagcactaaactactctttgattgtttttttataagactctttcctattttggagcgtctggttaattgatttcccagatcagcgacacttttttgtttttaggcatcgggtaaattagtccactggactaatttactcccactcaattgaaacaggtatcctcctatcccttgtaggacaagggactagaagtagtatatacatcaaaggggggagttttaggggggattgattttttcatatgttgatttccattaaattttactttagtttcgtgtgcagtttgtatgtttattgcattagtgagtagctgggctatctccttatcagcaccactgtacaagtgagcatagtgacgcaaagttatctcaggacttgaatgtcctaatctctttgaaagcgcaagaatagaagcttttaactcatttaaaacatagcttgcatgactatgtcttagacctttaggttgaatcctacgaacacctgcaagctctgcatatctatttaatattcggtttatggttgattttatcatagggtagccatcgtaagtaaatataaagtcattttctttaccaagtcctatttgagtttgtatttctcgccattgccttaatatactgacagttgtatcatccaattcaatgattctttttccatcatctgtttttgtatattcttttctaatgaagttttttcttgattgaacctcaagcatgtggtgtatgcgtaattgttgttgtccaaatgcaatatcactccaatacaaagcagttccttcattaactcgaataccagtcgtataatatagatatagcattacaaaacataaatgttcgtatacatcatctaggcatatttgttgcaagactaactcgaattccgtccttgtccaatatgggacaatttgctttcctttcggaattgcctttactttttttgaaatattgtattcaagaaaatttctctcgacagctttatcaagtgttttacgaaacataccaaaaactagggaagcatatgattgactgtaacctgagcctccattgttttcatctgtcagtagccaaatcttaaaattatcaacatcagtcacgctaatttcacgtagttttaaatcaccaaatttttcaataataagttgtaaagctggatatctagtattaaacgttgaggtctcgacgtatgaacgatagtaaggaatatatactgtgtccataaattctcgatacttcatatggtaaaatgaatagccatctgctttatggtattctctttttattctagtaacttctttatgtgcttgaagtgctgatgtaaagatattcccgaatctatcttttgattttttcctccttatcctctcacctgttgctttgtcagtacctaattcaatctgataaaagaatttacctgattttaggtctttgtaaacacctggatacttagttttttgttgggttttgtttgccattctcttctgtctcctctgaaattgttactccaattaatgattcgacagcagaagctggaacaatagcaagtctcttgttattatacaaatagtaaccttgattgacaagattcagtttaacttgtttgataatgcctgtggcttgatattttgtaaaacccatctttatcaaatgggatttttcaatcattttgtctgtcatcattttcctcctgtgaaattttgagagtcatttctttgtacttgttataaacatctgaattaaattcaattttatctttatcgcaatcgtagtaaggattgtctattcgctcatattctatatatttatttttttcgttatcaaatttgtatgtaataatagatttatcagttacttcttgaagtagtgtaatccgtctaatgagctgaatcacagtatcaattttcttatcaaagccaacttgtttgctaattgattcgtaaaattgaaaaggcgaaaatggagtgtttattattattgttgttgcaataattggtttatcaaagaaacgactggaagcagtagcatcagcgttgaatgggtcaatgataagtaagaagtcagcgtaattaaaattacctccccgacctggtctgatttcctcgataattatagtttcttgtgaagcgacattttgaaatgggtcacgagaggaacctgtagtatagaatggttttccaagtgattttgcaaagtgtttgcataatctcgattttccagttccagatggaccataaagccaaattatttcccgcttaaacccattttttagtgcattttctttccaattttcaaaatcaatttctgttcgtcttttcttagctcttgaaaattctctatcgtatttcacaagtgtatatccatcaacctctttaattgcttcgtcgaaacttatatctccagcgattattttatttatgagatttcggacaacgttgattgttttttctttcctagagttagattggatttttgactcaatgttttcgattctttcagcatagtcaaagtttgcgataacttcatcaactgtatattgatgtttttcactagcatcctccgtacgatgaattaaataagaataagcgttatttactttacctttccatgcttcgaaaaagtttgattgaacctcaaacccattttgtgaaagcttgttgataattgaatttaaccaaacagcatttttaaacctgacgataatatgatagtgtggttctgtatcaatatctttatcatgaatgatacctgcaatttcaaatggattcaatgtttcttgaaataatttgattatttcttgcaaatttttaattgaaacactttctactgttgaacagaacatataagcagtatgtcgaatagaaggtaccttttctgacatttttctctttttcttcattttattcctttcaaatcttgacaatgacaatgtaattcatgctgtctataacaagcccagacagcatttttttctagagcagatgttactcttgacaatgacaaaataaaaatttggatgatttaatcgctatgtttcgtcagtgcaaatcttcaataaatgttcttacgaaatgcacaattgaaatagaattttagaggaaatatgataaatttttcattattttttctcaataatgcatgctaattcttgtataaactagaacgatggaaaaattgattacttgttaagcgttactgctcaatagctagtcattgcccttgttgaggctgattttctaaagaactgtgatttcattcatctgtctcgcaggcctcaacagcttacattcaatcacagttcttaaaagaaattatcagcaaaacaacaaatcgggcaacgatagattgagtatttcacttaagtacaagcaatcaatttttatcggtttctagagttattttaaagaactagtcatatattaactgagaaagccaatacaaaaatcgaaaaatcgggttatcatctttccaatcttcaaactctctttctgctttgcgcttatctcgttcaagaacacgtatttcttgattcacacttgcacgttctctaatagcgtttgaaatatctttctcaactttttctttgtcactgagcaatcgatttaactctacatttctagaagttaatactgactctgttctttttaaatcagcttttgtattttcaagttgctcattgtacagcttttcttgtagtcgtaaaacagaagaagtatcacaatattcaccagtatatttatttttaagtactaaaaaaactggtgctttttcacgctcttcatgaccgattatcatgtcttctagactacttgaacattttaacttgaagtctttttttgacatttcactataagtgatgagggcaatgtcaaagttagttgcttcattttgtagtgtatgctcagcgacagtcgatgacaaagttatcttcatttttcagtttacctttctttttaacgcttaaaataattgaattgattcagctctgaaataaagcgcaccattgtagtcataagcttctaaattatgaaatttatatccaataaatattttcaaattcttgtttaattcagctggaagtgcaacttgaaacggctctgaattatcttgcataaaccaatatttgtatcccgctatcttatccgttctaccattatcatcgtacttaaatttcaaagtatagtcggtagataacaaatagtatggtttactaacatcagttacaacgctcgccaaaactgaaggacttagtttttttgttttcattcttaattttcctctcatgttcctagtcttttttgtagtatacttatgtgttaaaatattctacaaagagttaaaaaatcaattaacgttaatctatattcattatatcttctataaacttgtgtgtaaaaaacagaaaatagttcgaatccgaattcgtaaaattataaaatattcaagttatataaataggctcacatgctaattagtagatttcagagttttaagataaaatccgggaggagcaatgttatgaaaatatatttcaatgaaaaagagcttgaaatagcttctgtagcaacatttttggagggaacatatgacttcgtagaatacaaaaataatattttttatgaacatattaaagagtctgataagttaaatggccagagtaggactgaccactgtatattatttagaatttttcaagaagaagttgaagaattgatttctaattcaatgttagtagaattaagcaacaaactagcaaaagtatttactaaggagccacttgtaataaactatactcactggattgtggaagagattacaggcaaggtacgactaaataataagaataaggagcagatacataagttaattgctgattttatcctttacatctctgaaaattattatgataaaaaaatggagactcaactacttgctactgaatcgttagttacacttatacaatttgttgatggagatatatttcttaataaacaagaaattgagtttctaataaataatcaataccttacaaaatctttacagattaacattgagaagaatgatgattataagctcgaatctttaatgcgtctagtcagaaaatgctcaactgacaaccacaagaattttaatggtcactacgaactaaaggcaacacttgaagcaattaaacgcagtcgattaagcaaatcgccacagaaaatttctactcttatccctgaagattatagaaagttagaaaagaaatgggaaagtacaaagatacagttgcaaaattatattgaagaatatcgaggtttagaccaaaatataaactgtactttaaataaattgaatgatgatttcgaagactattatttggaactaagaaaatgtattcagaaagttacaattactatgcttatcattgaaaatttgaacagtagcagttctgagttggaaataatggctatcgaaaatgtcctagattccttgaatattaagaaatactcttttaaaaatattttgcaaaaatggaaagattttgagaccgaactcaaaatgcaggaccttgagtcgatgtattacaaagatatgtatgatttaatagatgaatatttaggaaaagtaattgattatagcaaatactcgaatgattttgaaaagtccattattcaattattacttaaggttgaagaagcactcgcaattacagataatagtgataaattgtatatagatattaaaaagaaacttcagcagtccaaggaggattgccttgaatatgccaaaattattgatatgagattaaaaaatttcttagaaaaccgaatatactaaaagccaagcaattgtgcttggcttttagtattcatctagttcatgtttgattatgtcttcaacattacattcaaggatttcacataatttatcaattgtttttgttgttattggttcacctaatttcattcgatgtaacgtatgtgcggaaattttttcaaccttgattaaataatattctgaaattcctcttttattcaaagtatcatagaagggtttatatgaaatcatgttattactcgctcttaaattctcttatataaacaatatggtaacattaccaacatattgactatattcaatttattgagtataattttagataataaacgtattagaggtaaaaaatggatgttttattctctctaaagagattttcaaccttaaaaaataatctaatcccctcaacacaaaatagaataaaagaacttggaagagaaatttttcaagctgaggctactctgaatgctatttcagatgaaaaagtatttcttgaggactttaaatgggatattcgcacaagaggatttactatttttaatctgattcacctaccgtccctgattgtgtttgtcatatttattatggttacacttttatctttagcagggattaccattattggtgtcattatagaaacaattattcgaacttttatacttttccaagattttgagtttgaggatacattcttctatatcccaataaaagcggttgaagactttatttattatccaccttcaattcctattccgattgtggttgggcttttgatagtctgggttctatatagtatcagacaggttcaaaaaaataaaatctactatgaaaatgttgttattccagagaatcgaaagaaaaatgctctcgtccctggaaagcgtagaaaacaacaattagtggtagataacctgaaaaataccttgaaatccactgaaactcaactactgaaccatcaaaatgaattgatgaatattatgaatactatttccattcccaaccagtattggactaacgatgaagtcataaatttcctcatacagaaattagagtatgggcaagcgaagaccatcggaaaagctttgaatctttgggatatagaagtatcaactagaagggttgagcaggcatcgaaagctgtcataaaagagacaagagaatcggaagctcgtctagctagacaacgtgcagaacaacacgcgcaagagcaacgtaacattagagataataccgaagctcaaaataaagtagcagaagaattaaaacgaaggaatgaccgttctgagttctatgatgatattgcgaagaaaaacggttggttataaataaggagactcactatgaacaaaaagaaaattttagcaagcttgacactattggcatctacagcactcttatttgcttgtcaaagtaatgaaagcaccacaaaatcctctgaaaagattgttgaaacctcatcttcttcaaaggatgcaatctccgaggaacaaagaaataagtggttgaaggagttttatgaagaagtagctgagactgatggttcaaactatcataatgatattgaagaacgtagtcaaaaagcatggaatgagaatcaaaccaacattttcaatggacaggctagtctaaatgttactaatggctacctaccttctgaattgacaaagctaaatgtcacgattgacggttatgatgaagcaactagaagattgaaagttactgttactaacaactatgatacaacactgattggaacaacaaccaattcaaacaataacaacttgtacaggacatatttcactctatatggctacacaacattgtcaggacgttctgagagggttaaaatcgctcagattgctcttgctagtgatttaccagctggggagtctattcaacttgaaatcctttcatcagctcttgcaaattcacaatctgattatgctaaaaaatttcaaaatagtgagttagattctaaatactacttactatcaaccaattacggaaattccttatgggacattactaaagaccaagtaatgggagaagagattatttcagaacaaatagtattatctagccttgcgaatatctacattgtacccaagctagtatttgaaacttacccatctacagctccaaatgattctgagctagaaaatctaatttcaaacaattaaagaaaagagcagactgatgaacataaagaaactaatattgaccctactcactctaacgctgacaattgtcccttgtgcttgtggtaatcaatcgaattccaatgatagtcagttatcaggaacatattcatacgaaaaaggcggtattgatggttctgaaatgggattcgaagacgaagaattaactttgcattacgaactaaaagtaagtggtgatgaaaatatacttaatatcaatctcctttcagagagaggcaataatgtgaagtacctctattctgagaaagtaacaattgatacagacaaacagattatcagtgatagcaatggtactgaactggaatattcagtatctggagattctgttacaatacctgatttagcaggagatagtggtgaaacagtaacattaaaaagataatctcacaataataaaaaaggtcttgataggtctcaagaccttttttatgaacacttattcaatttaggtaacttcttgtaaagattggatttaaaatacctctaataccgaaataatgatataatatttattatcaaattagtgagtaaaagttatgtatatttttgaaacaactgaacagaataattccaaagcaaatgattttgaaacaaaatcgttactttatttaatgagttttaaatctgacagtacagatatagatacattttttgtagattgttttaatgatattactggagctagtagtgacttgttgaaactctgggatgttcaagctaagaacatttcttctctaagacctaaaactatcgggaaaagtctaataacattatttcaaaactttatatcatctgttgatttttatgagtatattctttttattccaaagttaaaagagaactatctaatggatatttcattaactgaatttaaaattgataattttaaagatatagctaaaatacaggagggtcttgaagaagaatataagcgaagaaagaagctaggtgcgctaaatctaaaacaattgtcacaattgaacacttttttagaacagatacattttgtaacaggtgatagttcaaaggccatctatatcaaaaatatcattcaatttaaaagtaatattagagatgacaatttctttgagtcagtttttaatgaagttagaagtaaacaaacagagttaaaaaacataaatatacataatatttcaatcaatagtattgaagaagttttaaaattaaacaaacatcttactaagagacaattggaaacattggttgttaataggataataggggttgaattatttaaacaacgtattccaaatgatttctttgatgtaatcaatgataaatcatcttcggataggaaagacattattcaagattgcaacgcaaatttatccagattattatttgataaaaatagtaataagaaaaaattttggtcacttcttgaacaaatattgattttagtagaagagaaagatgatatttatcaaattttaaatagaatcaaacaatatcaaattcctaaaattataaacgatgactatacattattatacctgatttcaatggttaaagaagggatggaagaaaatgcttgttaaaaaaattgctttcggaaatttagaagaagcgtttattgaagaaggattaactgacggtgttaatataatttttagtgatgataataacaaaggtaaaacgttattatttcaagcatttatgtattcaattggcaatacacctattttccctggaaactttaaaaaagaagattactatttttattcaatgattaattgcgcaggggttgattacgaatttttacgaaaaaaagacacatttctggttatttttcttcaagaatttcatattttcgaaactctttcggaattaaaatactttttaaaacaacaaaaaatttttgatattccagtgattgagaaaaacggtagggaaaaagtagcagatttagaacttttttatgagttgttttttgttggacaggataatagaaatccctcaaatattattaataaaggatactataataaaagtgatttttccagtatgatagtcgcattgaaaggatattctaatattagtaatagtaaagaattagatgaaataaaagaagaaatcaatgcagtcaagaatgaaattaaagccaataaaaaatatttaaaattacttaagacagataaacaagtttctagttatttggataaattcactagtaatgaagaatttgagaattttaaaaatcgttcgaagcaactaaatgataaaattggagaaataaaacgagaccgaaatagagaacaagctagacaggataaattagttcaactattgaaagagcttaattcgcttaatagggaaataaaaagcgggaatgtttattgtacagattgtggaagctctcatatcagctttaaaaatcgcgatgttaattttgacttaagtaatgctgaggttaggaagcatgttttaaattctattgattttcaaatttcaatgagcaaaaatgaagttactgagttaaatgaagaactcaataaaattcaagatgaattaaaaactcttttaatggatacccctaatgattttagaaaaagtttattgtattctgaaattatcaaaacagatatgaattatgatgataaattgttggaactagatagaaaactacacagcttacaatttgacaaatcaattatagaacaaaaaggattaacaaatagggatggaataaaatcaattaaagagaatgttgttgcaaaaatgaatactctttataaagtgattgacccagatggaaagttagtctttgatgatttatttactaagaaggaagctacatattcgggaagtgacggacaagtatattatttttgcagactaatctctctaaataatttattaaaacatacttatcctattatcaatgattcttttagagagggggaaatttcaactagaaaagaggagctaatgattgattattataagaaattaaataagcaagttattctttcggctaccttaaaaaatcaagagtatgctgtcgacaaatactcaaatatagaaggtgtaaataccattgactacagtataaatgatgacagcaagattcttaattcaaaatacactgatgagtttatacttattttaaaaaagtttaatatagaaacatcgacaaattattaaaaaactttttcagttttacgaattcctgtattaatttttaaaaaaggaaatagagtataaaaaaagaattagctagaaattttttctggctaattctttttttcggggggatttaggggggaatcaaacaaagattcaccctttttagactagtttgttcctgctaaactgctgtagaatctctattttgaaggtaaatcaagcctctccattattcccactcaactgttgctggtggtttacttgttatatcatagacgatgcggttgacgtggtcgacttcgtttacgatacggacagagattttttgaagaacatcccatggtagtttggcaaagtcagctgtcattccatcgacagaagtgatagcacggatagcgatagtgtagtcgtaggtacgaccatctcccatgacacctacggagcgaacgccagtattaaccgtgaaatattgccacacatcgcggtcaagacctgcttttgcaatttcctcacgcaagatagcgtcagattcgcgaacagtttgaagtttttcctcagtgatttcacccatgacacgaatggcaaggcctggtcctgggaatggttggcgccatacaacttcatccggcataccaagagcagtaccgagggcacgaacttcatccttaaagagagtattgagcggttcaatcaacttgaactgcatatcttctggcagaccaccaacgttgtggtgagatttgattgtctcagcagtatccgttcctgactcgataatatcggtataaagtgttccttgcgctaggaattcaacatcagtcaacttgctcgcttcatcgtcaaatacgtaaacaaattcattaccgatgattttacgtttcttctcagggtcagatacgccagcaagtaggtctaagaaacgcttagcagcatcgacgcgaataatattgaggccaaatttaccgcccaacatctccataacctgatcaccttcattcttacgaagaagaccgtggtcaacgaagatacaggtcaattggtcaccaatagcacgttgaagaaggaccccaacaacagacgaatctacaccgcctgacaaaccgagcaagactttcttgtccccaacagtctggcggattttttcaatttctgtttcgatgaagttttccattgtccagtcgcctttggctccacagataccaaacgcaaagtttttcaaaatatcgtttccatatacggaatgacgaacttctgggtggaactggataccgtagatacggcgttccgtgttttcaatggctgcgtaagggcagtcagcagaaagaccaaccaggtggaaatcagcaggaatttcagttacagcatccccgtggctcatgagtacaagctgttcttctggtgttccagcaaaaagcgctgattcagtcttcagttgaagatttgattgaccatattcacgatttccagcctcaccagcaggaacaaccttacctcccaatttatgggtaattaactgcataccatagcaaatccctaagataggaatacccaattcaaagatttctggatcaatatcaaaggcattttctgcgtagacagagtttggtccacctgaaagaacgataccaattggattgatagcacggacttcctcagctgtaattttatggtttttcaattctgaaaagacaccaaattcacgaattcgacgtgaaataagttggttgtactgactaccataatccaatacaataattttttggacatcttgttttgtcatgtttttccctttcgttttgaaaaaaattcaaatactagtagttagcttaacataaaagcgaacattttccaaattttatttgttaaatatctgttttgcaaactatgagtgataataaaaatgttagtgttcgtatttttattgtttttactcactttattttaggtaatctgacttcattgtttgcctaggagaattttaccaatagagtgtggcctgaattagccaaacgcctttatttttggtaaactagaaagaagagaaaggctagataaatgaaagcagcatatatcacaattcacgataaaattaaggaacaaatcgataacggaatctggaaaattggtcaacgtttaccaagtgaacgcgatttagcagatgaatttggtgtttctcgtatgacgctccgtcaaggaatcacacttttagtggaagaaggtattctacaacgcaagattggttccggtacttatgtcgccagtacacgggttcaagaaaagatgcgaggcacgacttcctttactgaattagtacaactccaaggaaagacgccaagcagcaaattattgtcctatacacgaaccaaacctaatgaaaaagaagttgaacaattaggtttatcccgtggcgagtatgttattcgaatggagcgggtccgctatgcagataatgttcccgtcgtgtatgaggttgccagcattcctgaacgcttgataaaaaatgtcccaaaagaagatgttaccaaccatttctttaaaacacttatggacaatggttatcgaattggaacgagcaaacaaactatttttgcgcgtttagccaatgaaaaagtggctcaatatttacaaatttctaaaaaccaggctattctcgcactaaaacaggtatcttatctcgaggatggtcaagcatttgaatttgtaaatagtcagtatgttggggaacgtttcgaattctatttagaaaacaattaacataaaaataattatgtaaaacatttttaaaatccgtaatctttctagtgatgacggattttcttatttataaaatatggaatttttgatataatgaagtttatggaaattgaaaaaaccaaccgaatgaatgccttatttgaattctatgcagccttgctaacagacaagcaaatgaactacatcgagctctattatgccgatgattacagtttggctgagattgctgaagaatttcaagtcagccgtcaggcggtctacgataacattaaacgaacagaaaaattactggaagactacgagatgaaactacatatgtattctgactatgtagtgcgtagccagattttcgatgaaatactgaacaagtatccagaagatgcttatttgaaggaaaaaatcgctattctaaccagtattgataatagagaataagaggagaagtatatggcttttgaaagcttaacagaacgtttacagaatgtttttaaaaatctgcgtcgtaagggaaaaatttctgagagtgatattcaggaagcaactaaggaaattcgtctggccttactagaagccgacgttgccttgccagttgtaaaagactttatcaagaaggtgcgtgaacgtgctatcggtcatgaagtcattgaaaccctgaaccccgctcaacaaattatcaaaatcgttgatgaagaattgacggctgtattaggttctgaaacttcagaaattatcaaatcaccaaaaattccaactatcattatgatggctggattgcagggtgctggtaaaacgaccttcacaggtaagttggctaataaactcaagcaggaagaaaatgcccgtccactcttgattgctgccgatatttatcgtccagctgccattgaccagttgaagacccttggtcaacaaattgatgtacctgtattcgagttaggcaatcaagtccctgccctggagattgtacgccaaggtttggagcaagccaaggctaatcataatgactacgttctgatcgatacagcaggtcgtttgcagattgaccaagccctcatgactgaactaagagaaatcaaagagtttgctcagccaaacgaaatcctcttggtcgtcgatgctatgattggtcaggaagctgccaacgttgcgcgtgagttcaatgatcaactggctattactggtgtgattttgaccaagattgacggcgatacacgtggtggtgcagccttgtctgtccgtcacattactggtcagccaatcaaattcaccggtactggtgaaaaaatcacagatattgaaaccttccacccagaccgtatgtcctcgcgtattttgggcatgggcgacatgctgaccttgattgaaaaagccagcaaagaatatgatgagaagaaatcactagaactcgctgaaaaaatgcgtgagaatacctttgatttcaacgatttcattgatcagctggaccaagttcaaaatatgggaccaatggaagacctgctgaagatgattccaggtatggctggtaacccagcacttgccaacttgaaagttgacgagcgtgaaattgcacgaaaacgagctatcgtatcttctatgacaccagccgaacgagaaaatcctgatttgttgacaccaagccgtcgtcgtcgtattgctaacggttctggaaatagctttgtcgaagtcaataaatttatcaaggatttcaaccaagcgaaaaccatgatgcagggtgtcatgtcaggcgacatgaacaaaatgatgaaacaaatgggaatcaacccaaataatctccctaaaaacatgccagacatgaacggtatggatatgtctgctctggaagatatgatgggaggagctggtatgccagatatgtcccaaatgtttggaggcggtttgaaaggtaaaattggtgagtttgctatgaaacaagccatgaaacgccaagccaataaaatcaagaaagccaaaaagaagagaaaataatctcttcttttttactttttattcgaagaagtaagatatagcaatataaaatagaagtagcaaagcaggaaaaatgattttcaaactccaacactttccgttataacagaaatattcaaaaatgtcctttttagtggacaatctttatattgttcgttataatggaaatataatagaaattagaggataagttatgaattatatcgcaataataggagatattgtcaattcaaaacagacttcaaaccgctctagtattcaagagcggctaaaacagcagctaaatagaatcaatcattccttcgctcaggacttcgcatcgccatttaccattacaaagggagatgaatttcaagccttatgcaagcctaacccttatattttttttataattgaccaaatccaactagcctttcgtgatgaggtggagattcgatttggaattggtttgggtgagattctaacagctatcgatcccaagctaagtattggagcagatggtccagcttattgggaagcacgcaaggctattgacttcattcatgacaaccatgactatggcaccagcaaaattgcattttcatctgaatacaagcaaatcgatcgtgtgattaaccccttgctaacttctagcgatttcatcaaagctgcctggaatcgttcgcaaacggatctgtttgagaccttaatctccaaaaaaatctatcaagaagatttcacacaaaagccaattgctgagaaaatgaaactcagtcaaagcgcctttaccaaacgtttgaaatccagcggaatcaaactctacctgcgtaatcgtcaaactgccatgaatttgattctccagctcagtcagaaagaaggataaagcatgtcattttcagttatttctagctatcttattcaacatccagttttaaccgccttgcttattgcccactttttaagtgattttaccttccagagtcaagcactggcggatgctaaaaagcttcatttgaaagctcttttcatgcaccttttcattgttgctatccctcttcttatcctagccttacttacccctattcaaaacggagatttattttttcaagtttggctgagccatcttgcgattgactatgtcaaatattttctcaacaaacaccattggataaaggactcctgggaagctggagcattcctagttgatcaattgctccatatcatctcaatcatcattctttatcacactatcggtgttaatgtcgcttcacactcactctggattgaaccaaattatctcctcctgcaaatcctttttatccttctgatcagcaagcccgtcaatattcttttcaaactctactttagcaaatatcaggtagcggaaggagaagaagagcagactgtgacaggtgcaggagccttgattggtcaattggagcgcctcataatgggaatttttctgcttctggggcaatacacagctatcggactggtatttacagcaaagtccatcgcacgctatgataaaatatccaaaagccaagcctttgctgaatactatttaattggttcgctatttagtatcatcagtgtcctagtattgtacgttttattgattttataaaacaaatagtttacataatttattttgtgtaaacttttattataaaaatagaaagaaatactatatgattatttggttaaatggcccattcggtgtcggaaagactactttagcaaatatattacacaaacgaatagaaaactcatatctctataatcccgaattactaggtgatttcttacaacatcaattacctcagactgtatgtcctgaagattttcaagattattccgtttggcgacagagtacttataaaatagtatttgatttagcgactaaaaccgataagattattattattcctatgacaatctataagaaagaatattatcaggagattattcagcaattgatacaggataagattcctttggaacattatattttgttagctgacaaaacaaccattttggaacgtttagataatcgagtcaatgaagacaacatctgggccaaaagacatcttgatgattgtttatactcaatgaaaatcaaaatctgactaggcgacgtagatgcagatagaactgaagttcatcaaaacaagtcaacaacgtctgattttgattttcgaagagtattaaaatcttttgaaagtcagattccaggacaaaggtttaaaacagacagtttgaagccagaagaggttgcgaagaagattctaatgctatgtgagtttaccgagaaataatctagatttttaggattttggacgtgaaaaaaattttctagttatctcgaaaactaaaaaattatgaacaattgacctaatatagcctgaacccttgataatactgagatagaagcataaagtacattcttcaaaaaatgtactttatttttattttgtacattattttaggattcaataaggtacaggattaaagcatattattgtattagtgttagaaatccaattgtacaaaatgtagtagaaaatagaggggaggagattggagcaattgtacatttttagatgttagtcgtagagcaaaaataataaaatcagctaatttctcagattttcttgataaaaaacttgacgtatattcaaatatactatataatgaacttgaaatatcaatggccgcccttgcttcaattgcacagacatgttctgatgggtggtttttttgtttaaggagtgttcaaatgagtagtttttcccataaaagttttgaggaacaagttgctttgttagaatcaagaggcatgctgttttctggagagcaggacaagaaaaaagctgagcaaaagttatcaataatttcttactataaattaaaggaatttgctagacctttttcaaaaattgtgacagttgatggagtgcgtcaaataaattaccaaaacaccccattcaaaaaaattactgttagatattatcaagataaacgattgcgtctccatctattggatgctctcgaagacattgaggtagctttaaaacccaagtagcatttgttttaggttataggagattagggccatatggatatttaaatttctcacagtggtgcaataaaaaagagtactgcaagcattacctaaaatatcgagaagagaaatttaaaaagcagctcaaagctgaattgaaaagaacaacttctccagaaatcaaggaaaaattgaaaattgacaatatgaaatatcctccaatttggttggctattaacctaatgacgttcggtcagataatcaaccttatcgaattgatgtcaacaaataatattagacaaatagctaaacaatatgattgcagtgatgctgagttactttcttggttgaaatgtttgaatttattacgtaatatgtgtgctcataattcgaatattattgatcttaaaatgcatacaacaccaatacttcgtgaagaatggaaggagctcttatacgaactaaaagaaggtgtttattcaaaccgcattgctctgccgattattatagtgaaatatatgatggatgctattgataaccaatataattttagagaaatttttggttcatttagaaagttgattgacaaaagccaaaggcaagcaaattactacggccttaaaaacaaggaagtattgaattgtctgcaacataattctttgtatactagaatttgaaattagaataatctttgtttgctaaatattaagtagatgcattaaaaagtcactcatattaagaaataataaaacaggtctaaagtatagatctgttttaaatttatgtaaaaaatgggggtatctctatgtccgaaaacatagagttttaggtatcaaattaactagaaaaatgtactttggaaaaaatttccagttttgtcgttattaaagtacatttttagctgatttttcctaaaaaatttttttggttatctttctaatatccccacaaacatttttccgaaaaactataattttcttgaaacttatataaggttatgctatactactcatataactaaaaatcaggagaaaatgatgagacgcgagttattattggaaaaaattgatcaactaaaagaaattatgccttggtttgttctggaatattatcagtcaaaattggctgtgccttacagttttactaccttatatgaatacttgaaagaataccgtcgtttttttgaatggttacaggattcggatttggtggctgttgaacggattgctgacattccgctggatgttctggaacatctgacaaaaaaagatatggaagctttcattctttatctgcgggagcgtcccttgctgaacgccaataccacgcagaatggtgtgtcgcagaccaccattaaccgtaccctctcggccctttctagtctcttcaagtatttaaccgaagaagtggagaatgagcagggcgagccctacttctaccgcaatgtcatgaaaaaggtatctactaagaagaagaaggaaaccttggcagcgcgggcggagaacatcaagcaaaagctctttttgggcgatgaaacgatggagttcttggactatgtggacaaggaataccaagtcaatctctctaaacgtgccctctcctccttccagaaaaataaggagcgggatttggcgattctggcgcttctcttggcttctggcgtccgtctgtcagaagcggtgaatttggatcttcgagatgtaaacctcaatatgatgattatcgaagtaactcgtaagggtggtaaacgggactcggtcaatgtggctgggtttgctaagccctacttagaagcctacatgggcatccgtcagcaacgctacaaggctgaaaaaacggatacagccttcttcctgtccgaataccgtggtctgcctaaccgtatcgatgcttcttctattgaaaaaatggttgccaagtactctgcggacttcaagatacgcgtaaccccccacaaactccgtcacacattggcaactcgtctctacgacgccaccaagtcgcaagttctagtcagtcatcagctgggccatgccaatacccaggtcaccgatctctacacccatatcgtcaacgatgaacagaaaaatgctctggatcagttgtgatatcacgtaatataaattatgtaaataaattaaggagtaagcgaaaacttacccctttttctcttaaatctaaatcaatgctttcaatttttcctgattgactgctgggtactggtccaaaaaggctgagagagttcgtaaaacggcaggtatgtgtccagtctggtcattctccacctgcaagaccaagagcggctcgtggaggctcatacggagcaagagccagccgtcaccataaggctcagtcaggtcaaaccgcactccttcttcgttttctgggttaaaagcaaagccttcgaggctggtttggcggaggtcagcaatgacctgttcaccaagcgctcgatagtctgtggcttccagtttgaaccgcacttcttgggtttccaagggttgcttgagctgggcaatcaagtcgtccaaggacttgccttccgcttgcagtttgggtaagagcatgagaatcttagccgctacatacgttccgtcatcgaggaagtaattttccttaaaggcagcatgtccagatgtttcgatagccaactggcaatcaactccttcttgattggctaaaatagcacggtttatgacattacggtagcctgaaatatagcgaatttgtttgcctcccagactttctataaagaccttaaggtgttcagtcgttggggaattggtcacaatgctggttcctggatgttcagctaggacaatctggctgagaacggcaatcaggttgttacgattgagaatttctcctgacttggtgaccagggcggcacggtcaacgtcggtatcaaagataatgcctaggtctgcaccttgcttcaagacagcctgacgaatgctttccatagcttccttgttatctgggtttggaacatggtttgggaaggtgccgtctgggtctaggaattgtgaaccagtggtatctgctcccaattctgccaacactttctcagcaaagaatcctcccgcaccatttccagcatcgacgatgatattaagacctgtcagtggtttttcttgtccaccacaggcggtacgaattttaccaaccagatcttgggcataaggcgtaatcaggtctgcactggtgatacttccaagggaagaagctggcaagtcttcactatgcgagaggatgaagtcaatatcttcatgttctgctccgccattttccgaaaaaatcttaatgccgttgaagtaatagggcaggtggctggcagtgatcatgacaccagcgtggcacttgaactgcggatactgggtgctcatgaagagagctggcgtggtggccatgccaaagtcaatcagctgaacgcccagacaaacggcttcttctgtaaaggctgcgaccaaatctggaccgctgaggcggctgtctcgaccgataccgatggtcaattggcctttttgatagacctgcgccagttccggcttctgagttagccaatgaataagtccgcgaactacttcctgggtggcttgtggagtgagattgacagcatattcgtctgtagcgatagcaattccacgaatatctgatccattttgcaagacgtgatgatgggacatagtaacctcctaattcaaactaaatttagtatatcatattttcgaagcggtttcaaaatgaaaaaagcacagcttctactgtacttttgtaatgcttacagttgtcccaatttccagttgactttccacggaaatagctagttccaactgattcaagacccgcttggtcagatacaatccaaatcctgtcgctttttggtgttctcgtccattaaaacctgtaaatccctcgtcaaacaggcgaggaaggtcttctgccagaatcccaattcccgtatcgaaaatggaaattcctccattcaattcaatggccacctttccaccagtcttattgtacttgagggcgttgtcgataatctgtgatagggcaaaactaagccactttctgtcggttttcagtagccaatttccatcgataatcactgaaatgtccttttgcaagaactgattgcggtattttttgaccaaatccaccaccacttctcttacttccacctgctcaaaacgaaaatcactgacatggttggtcagcttgaggtagttgaggagattggccatgtaattatccaagcgtaagagctggtgattgacatcctgctggttgagattgtcagtctggctcatcaaagacagggcagccaaaggcactttcatttggtgggaccacattttgaccatagcttgcaggtcttcttctcgtgacttatagaccaaaagctgctcccgtgtcgcctccttctctgcctcaatcaagttgagataggccaagtccacaggcttattaagcaggggcagagcttcttcatggacatagtcttccaaggctctcatgcggttgcgaaacttccagaaaagccctacagttagaaggattaagaaggttagggacaatagcagagcgttttgcaggaattcggtgggcagttgatagagaaagaagagcaagataaaactagtagccagaacaatgtaggagaagtaaaaactccggtattcgcggataaattttgctatcatttgatcaagtaccccacgccacgaacggtatgaattcgttcaaacccgacttcgctcaccttcttacgcagtctggtcatgtttacattgagcgtattctggtcgataaattcttcattttcccagagtttttccaagagttcatccttgctgacaatctgcccttgtctttctagtaaggcggataaaatcttggtttcagtaggtgaaagctgaacctgttccgattcgtttgaaaatcgcccgtccaaactaagctggaactgatcgatagacaattcgctcgatttgctgaattgattaacccgacgcaggaaggctccgattttggcatccaaaattcctagagaaaatggcttggagacaaaatcatcgccacccatgttcatggccatgaccgcattcatctcatcatcgctagaagagataaagataatgggcatggtcatggttttacggatttctgtcgtccaataaaaaccgttgtaatagggcaagttaatgtccatcagcactaagtctggtttgatttccgcaacttcctgactgacagctcggaaattctgcacactttctacctgataagattttcccaaatgctgcttcaagagttggacaatcatctcatcatcttcaacaatataaatcttctcttttttcatcttcttcattctgcaaaagccaggacacaggtcttggcttatatacttccatttctcatttttatgcttgtcacaatcaatttatcatcttcaatattaacgataaccctgtaattgccgatacgatagcgccattggccagaacgattagcagtcaaggcttttccgtattgtctagggttgtcagtcacatgactggacaagtagttggtaatctgtttttgggtaaatttgtccaactttttcaactgtttaataaaacgactggtcggtacgagtttataacaggtcttcatccgtcaaccccaactcttccaacatttcctcccagctaatcggctcaatgcctttcgccaagtctgcctcgtattcagacagagcgatatctgccacacgggcatcatattcatcttcgagagcttcaagggttttagtccgaatgagttctgacaaactgacaccttcaaactttgccatagcctgcataaagagcttgtcctgctcagaaactttcaatgtaatagctgccattttctcacctcttcgagtattcctttggtattaccattgtaacaccatttccctgaaaaagcaagaaatctcgcacaaggcgagacttctgctaccgttcaataatgcgataataagtgcgactagtccacttgtaaatgacaaagtaaatcagagtgactgccagtagggtgatgccactgactgtgtaaatcattagtgatgaggtaacaccaaaacttagtagcatttgcttgagcatgataagggcgatgacaaagtgtagggtcgccatgaccaaaggcataaagaagaccgtaagtgtttgggagttaattgttttcttgacagccttctggctcatgcctacttcttgtagaatcttgtaggatttcttgtcctcatgcccttctgaatactgcttatagtagataatcaaggctgcacccagtaggaaactaattcccagcaagaaacctgtaaagaggaaaccgcctgtaaagcccatcagtaaattgttgaaatccgtacgttgcataacatttccaagatattctccattttcatcgagaatttcgtatatttcaccagattgctctccaagagagagtacctcttcatcagtcaagtcggtaaagacacgataatctaggctaacaagatagccttgcggattattggattcgtaatactcacgaacagcattcaacactgtgtcatcactgactaccataacggcggcatttagcgtattggtgatgtctgggaaaatagccttatcaagattggctacattctcaaaggattgatcgcccaaaacaagcttcttcagcgatggtttttcgctcggacgcataaagaccacttgattggcagcaagctctggcaggtcattccccaattttctgaaatcatcttgggtgatgaagtaggtaaaggccattttagaaaaatctggattagaaatattttttgggctaatgacaatctcttcgccaccatcatataccagaccagcttggtaggtcagataggatagactgtcatcggctttttctggaaaatggctgagcaccgattgctggaaggccatttcaccttgacttctatccgaaactttataggtaatagatgtttccttgggatatagtgcacctgtcatactgctcatacctgtataaagggaggttgtggtcgcaatggtcacaaaggccatgaccgcaagtagcgtaatattggccaaacccgttgcgtgctgcttcatccgaaaaatcatctgcgatgtcgtaatgaaatgctctggcgtatagaaataccgcttgtttttccgacgagccttcaaataccaagtcataaaactgatgtagaacagataggtccccgcaatgacaaagagcacagcgataaagaaccgatagataacagctagaccttctgctttcgatgaaagcgataggtagtagcccatcccaagactaaaaacaccaagagcagctagaagaacatttcctttcggctctctctctcctttttcactagctcggaacaaaatcagcggactggtcttgccaatggtccgaatggctagcaattccaagagaaagaagaaaccagcaaagagaaaggcagtcatgacaaaggccagaggctcaattccaaaatgtaaatcactataatgtgttatattgacaaaaatcaagtagagaacatttgcaaacacaccagctaaaacagaaccaagaaccacaactagcaagaaaatcatcatcaattcgaggctagctatcaaggctacttttttcttgttcatccccagcatgttatagagaccaaattctctcgcccgttgtttcatcaggaaattaaaactataaatctccataatgaccgagaaaatggtcagaataatcacaccaagaccgatagaaatggcaccagagcccatggtcttcataactggactcagcatgatcaagaacatggaacaaatcagggtaaagaggaccagactggctaaaacgaagggagcaaaaacacccatggattttcggatattttgcccagcaagtttgaggtaaaacatctactcaccccctaaaagtgcagacatattgagtgaaatctccttggcaaagtcttgattgctcttgtctgccttgtacagttgatggaaaatacgaccatctttgataaacaagacacgtttggcgtggctggctgcgttggccgagtgggtcaccatgagaatagtttgcccgtcacggttaatctcttcaaacaaattcagcaagtcttccgaattgcgataatctagggcagccgtcggttcgtccgctaggacaatctgtggctgggtaatcaaactacgagcaatagccacgcgctgcttttgtccaccagaaagttcaaagggacgttttttcagcaaatcttgaatccgtagttttggtgccaatacttccaaccgtttctccatttcctgatagctctcacgtgccaataccagaggtaaaaagatattgtcttggatggacagggtgtccaagaggttaaaatcttggaagacaaagccaagattacgcaaacggaaatctgccagcttgctttccttgattttggtgatgtcttgattgtttaagataacagagcccctcgtcggcttgtccagggttgctagaatgttgagcaaagtcgtcttaccagaaccactttcccccatgatagcgataaactcgccctcttctaccttaaaatccacatcttgcaaggcacgagtttcctcttttgaaaagcgcgtgcggtaaactttttctaaatgattgatttctaataacatagttactcctaattgttttctttagcaaaattaacttgatttagtatagctaattttctttggtactaaatcccatgaaattgagtttctaattatcagctttataaaagaaatacatgaaattgtaaaaggtttttatttactattttccaaattcttgatagttaactgataaaaaataaaactaaacacaatattcactgtaataaataagataaactctaaaaatgtcatatcttgcaatgccctactccgtaatccaatcatcggttgagagtaagggaaaaatttcgtaaaactttcattgataaaaattaatacaaaattaagcatactaccaatggtagcaacaccgactcccttactgaaatttcgagtttttacagtgatataggattggagtgtaataattggaaaggaagacaaaagcgataaagcaatccatttaacatgtgtggctaaactaaggtcaaatgaaatgccgtcaatttttgccgcaactataaaaatcagcagcaataagagttgaattggaagaataagaagaaaactgctcattaattttcctaaatataatttcctcatagaaacttgattagcctttagcatgtcaagagtttttcgctcaaattcaggaactaataagagacctgcaataatggctaacataggaggataaagtaaggtactattgtaaaaggtcagttgtccccacagaaccaaagattgagttccgtcgattaaaacatcacgattagcaaaatagatacccaatcctatcatactagagaaactcaaaaaggcaatcccaatgactaataattgaattttccttgtttttgtccactcagctaagaagtaatctttcatcttagttccctttctttcttaatattagaaccgccaaaaggtagagtatcaagcagtaaatggcataacagacgattttctcaagcaactgactatctaaattataggtaattgtgccgtcacccagaaattgatatttataaggcgcaagacttcctgaaccagtgattgggttaagtaaactggtaaaaccataactttttgggtttaagataattcctagaaaaccacctaaaagtcctagtgctagcagaatcccctgcttttcaagaatcatggccaaggtcagataaagacaaatcaatgaaaatattgcaagtatctgcccaataaactgaataccaataatctgcaaagaaatagagattcctgcctgtgttccgaaaagataaataatcataatttcgatagcagacataataacaaaggaaaccagcataaaaaagaatttatcacgaaaaatggctgttaggctttgaccattagctatttgtagtttaaaggtctgcccttcatgttcattccctacaattcgactagcaaacacacaaactgcaatcgggaacataagtagattgacattctgattactaaacaaggttccagccattcttaactctggatgtgaagagaaagcagagataaaagttgcaatattccaaagtgtggcaaccaacatcaaaataatgacaattgaaatagattttgttcgtctactttttagccattcaatgtaaacaccattcatcttacgcctcctttgttagatttaggaaaatatcttcaagagtttcactttctctaaccactcggaatattcggtatccattttctattaaatagctcaccagatctgctaaccgatcgttatccaaatcccttaaagttacttgactttcggatgcactcaaaatttctaccgttccaagttcaactaaggtctgaacaatatttttctgtgaaaaatcaccgccaatttcaatccaagtatttgacttaatagcttcaatttctccctcatagacaagacgaccatgattgataatcccaactcgatctgcaatgtgttcaatttccggaagaatgtgactggaaataaagacagtcagacctttttctttggctaattgaacaattaattcacgaatttcatgaataccagctggatcaagaccatttgtgggctcatctaataataagattttcggctttttcactaaagcaaatgctaaggcaagtcgctgtttcataccaagagaataggccttaactaatttttttcgatttttttcatcagctaatccaacgagctccaatgttggccggatattatttttatcaaatcccaccattttttgaaacactaataaattttcatatccagttaaattaggataataggacggttcttctatcatagatccaatctgatttaggtattttttgtcatttcgaatgtcttttttattaataaaaatttcacctgaagtcggagtgacaagtgatagaatcattttcatcgtagttgtcttacctgcaccatttggtccaagaaagccgtagatttctccttctcgtacagtaatcttttcaatatcaacagtggtaacgtctttgtaaactttttttaaatgattgatttctaataacatataaactcctaattgatttcttaagtaaaatcaacattctcaagtacactttgatagtcgattcggtctgattcagcaacattttcttctaaatctaccttatagtaaccatcctggacaccgatggcccattccttgttagtggttacatagagattattcaaggatactgtctttttcactgccccttcttctttgacaacaggccattccataaactgaacttctgttccttgaatactatcttcggcaacttcctgtttgctaacggcatagacttttcccttgtaatggaaagtttgatagccctcatcaaagctaaaacctgctgaagaggaagagcaagcagttaggattatgcttcccaaagccagcatgctaattactttctttttcatagtttcctccctctagtatgccataaatcgcatactttgcaaattatgggcgagctcttctaagaataaggcttgttccatgagttcagctttctctttttcagagaataccttttcttctattctctttgcttgtagaaatttgaatgacatatgatttccttctttctatttcttatgagtctattatagaaaatattcctcctgtactctcttacagttctgattaaaaaacttacagctttgtaaggaaagaataaaagacaccatttctggcgtcttacagttagttttattttgttagaccaatataagcaatcatttcatctaactctttcttgctttccgttacaagaagataggcatcatttccctgaagttccgcaaaggcatctggcatccgtttgactgtcttaatcttaccagcgaatgtctgatggatatcatctgctgagtgaacatattcggtcgtatcacggcgggttgctaccaagcagtattgtggttcaaatctacgttcctcaactgtaccacctgttgcgacattggcataatcacggaaaagatcaatggaatgagcgtagttataggcttcaactgtgaaaccgcctgccatacggttattgtattcaatggcaatgtagtcgtccccatccttgaaaaattcaatatggaaaaaacgctctctcataccaaaggccttgataatagctctgccatactcaaccagtttaaaatctaattctttttcgataaagtaggcattgtccttcttggtttgcatcaattcaaatggagtatgaacataagtcaagcctgtttcaaagacaacattgccttcgtagtccaacaaaccatcataagtagtgataatacttgaattgacaaatttttcgaggaaataaatagttgctccatcccatgtctccacaaaccgatcaaaatcttctttattttcgattttgaaggcacctgatgctccaacaccgttgtctggtttagcaatcattggaaaaccaacattcttcaaagctctgccaaaatcacgttccgatttaacaaccacacctggaacaactggaacacctgcttttttgaaatattttttcatttcagacttaaatttggtctttttcaggtgtttaggcttagcaccaaaaatgttgaattgttcacggagggctgcatcgttttcaagccaatattcattgtgggattctacacggtcaattggaccatgcttgtaaataagaaaggctgctgcacgcttgacttcatccaagttttcaagattctcaacacggaagtattctgttaaggcattacgaagttcttcaggcaattgatcgtaaggttcttgcccgatacctagaaccgtaacgccttctttttttgccaattcaatggtaaatggttggaaattttctggataaaaaggtgaaataacgagataattcataggtagtcctttctagcttatagtccgatagaatgaaggaagaatggcatttgctttctccaccacacccagtcgtgggccacatctgttccccaagtatcaaaccaagctgggatactcttctcttcaaatgcacgtttgaggttatagaatgagtccaaaccgtcttgctcccaatcgcccaaacctgtacagacgataatatcagcctgacggtatttatcaataaaccagccgtcgttttggttccaaatgtaatctgatggtgagttctgataaacaacatcatcattgccataatcttgattgttgttgaagaaacgagcatcatagacacctgaaagggcgataactttcgtgaaaacatctggatgttgcaggaagaaattgagcgcgtgataagctcccatagaacaaccagttgtcatcatcccatcaaaccaaccagttttatgtttgataaagggaatcgcttcttcaatcacataacgctcataggcacggtgagcctctgccttgtcatggatggatttccagtctgccaaccagctttcactatcgtagctagttagagtaaaaaattggacctgaccagcttcaatagagccacgacaagcttcaatcataccaaaatcagcatattcattgtaagaaccacctgatgaagcaaatacgacaacaggaatccctacgtgaccataacgatttagattcatttctcggccaagatttccagaccaatgacttaaaaattcaacgtgcatagtaaagcctcctatttgtatatttttgttttatgaccaatgttcgcttaggaatcgtaggcaagctggcaaatagagcgcccaagcctcttcattatggaccgcacctgaaacgacttccaaggcgatattgtccaaatccactccgccagcgatcaattgacgatagtaagtcaatgaagaattgatataggcctgcttgatatttcctgccatcaatgttttatctgtatcatctgcttcttctgtcccaacgtagatgtagactcgttgctctgagtctaattgttgacgttcaatataacggtcgaaagcatcttgatgaagccagttggcagatgaaaatactcctagacagccaatctggttctgataagccaatcccataaactgggtgatattgcctcccaaggatgagccaatcattgcagtgtgaactttatcagattttgtccggtattcttgatcaataaatggtttgacgacatccatcacaaattcagcatacaaggttcccttaccaccgaactgcaccccaggaatccccatctcactaaacttccaagcagcgtattcatgcatgcgatcagcaccatcgttatcaatagccactacgatcatttttgcaatgtctggattacgcttaatagttgggatgactttccatgaatgacctgaaaaagcttccttactgtagagtacattttgcccatcgtggaaataaacaacgggataggtctcttctgtattttcagcatatcctttcggcaataaaacacggactcgacgttttctttctgtaaatggtacatctaattcatgagttctcatgtccaaataaaagtaagacttattcatatctatctcttccttacgtattttaagtattatatcatagtttttctggaatattcagaaaatttagttatttatttgcaattttcggattttccgaacatagttagtcaatgtcacagaattttctcatacatttggcggtaataatctaattctttttcttctttttgggtgatgctttcaaaaatatctagcaaaatggtacctttatcacgtttccaggttgccacaaatcgccctttataaaatacaacaggtttgacaatacccgtcaacgtataaatgttacggatgtattttggatcgaaaaatgggttgtttttcttttcatagcccaaaagtaattgatcaaacccagcaacgaaaagacactgaggtaaatctgcctcatcaagcaccccaaggtaaaaccgctcctctccagctacttgaattgtttttaaatctaattgagccatccactctagaatggttgacttattttctttgaaataataacgagcatctgctagactgactggcccaaagcctgaaaaataccgacgtgctatttccagctcagctttttcccgagaaagtggctgaaagtctgtcagacgatgaaaacgcttggcaccgtactcttggtagacttccccacgctcgaccatgtagcgaaagagaccgccccaggcattaaagaccagcttctcctctttctgtgtcatcttttcctctcggcaaaggaccttgagatcctcacgggtcataggaccttgttcaagggcttctaaaatcagatggtgatatttctgcttggtctgaggactaaaaccgtcccgtccttctgtcttgaggtaatcggtgctgaccagccgcccctcatggatatagagaggaatttccgactcgagataggcatgaaccgttcgccgaatggaccactgacgagtcagttcctcctgccagctaccctcatgaaaatcctccgctgtcatacggttacgaaatccgacatgaacatagggctgaaactgagcctgcaaaccattgagattttggcagatttgttgaacagactgggggttcaacagaccttgtttctgcagaataattcccttccaagtattgtggtgcatcgtatttctcctccgctttctaatcccagtataacacaaaagacacccgaaggtgtcctgtacattatgctttcacaatgggaatccagagttccatttggtagtctggggaactcatgtctccttcaaaatagtactcaaaatctggtgcacctgaatggcgatagccgtgttcaggaaaaaaagtttctagcgcataacgccatcctgcatgaatagattgaggaacagggcctgttagggtaaaaatagcatagtcagcttcgtgaacatcaagaagttctaagcctaacttagtcgctttttcactatctgtgacatcataagcagccatataattaatcgtctcgtccgcttgagctaatgtacaaactccaaaggactgcccacttcctagagcagctaactcttcataagtatggttcttgaacaagtcttcccatacctgcggacacacttcgttactgattgctgtgcgaagaagtccagcaactgtaaaaccagccttcttttcaatacgaacatccatttctttacctccttggatggttaatgatagttgcaagggtaagaggaccttaaaaggcaaccccttacgcacttgactaggagaaatctgatgaaattgtttgaaggcaaaggcaaaagaatccgaagattcatacccatatttaagggctatatctataatctttgcctgtccttcacgaatgtccatagcagctcgcgtcaactttcgtaaccgaacgtattctgacaaggacatatctgtcagaatcgaaaagagacgactaaacatgggaacggaatatcctgatatgcgcaaaaattcccgttcatcgatttcgctttctaaaacggactctaggtaacgtacggttgcattgaactcttttatcatcaacttcccctttccctatcagtttaccatctaccatccaagttttcccgatacttttcgtcggaaaactatcggcttaaaccgtcaaaaactcttccaagtccttgagggaacgctctgctattgcctcataacgctccttcttatcgcggatacgcggtccgtccagctccttgatgataccaaagttgacattcataggctggaagtgcttgctttcggtgtgggtgatgtaaaatggcagagctccgatggctgtggtctgtgggaagatgactggctcttcgccatggaaacggcgaacagcattgataccggctactaagccagaggcggcagactcgacatagccttctactcctgtcatttgacctgcaaagaacaaatttggatttttcttggtcgcaaaggtctgttccaataagtttggcgaatccatgtaggaattgcggtgcataacgccgtagcggacaaactcagcattttcgagtcctggaatcatctggaagatccgcttctgctcgccccacttaaggtgagtctggaagccaacaatattgtaaaggctacctgctgcgttatcctgacggagctggacaactgcgtaaggtgtcttgtattcgccatcacgtggtcccttgtaatcttctggatattccagaccaactggcttcattgggccatagagcatggttttgataccacgtttggccatgacttcaatgggcatacagccttcaaagtatttttctttttcaaaggagttaagcggtgcttcctcggctgaaatcaaggcctcatagaaagcgttgaactgctccttgttcataggggcattgagataggcagcctctcccttgtcgtaacgagacttaagataaaccaagtccatgttaatggtcgagctgtcgacaatcggtgctgccgcatcgtagaagtaaaaaccgtcaccaccattaagcgcgtgaatcttctccgccaaggcgtcagacgtcaaaggccccgtcgcaatgactgtaatagcatcttcaggaatttcggtaatctcaccacggatgacctcaatcagcgggtgattgtgaatctcatcagtaaccgcttgagagaaattctcacgatccatggccatggcacctccagcaggaacacggtgagcctctccagcacgcatgataatggaatccaaacgacgcatctcttccttaagaaggccgacagcgttggtcaaactatcaccacggaatgaattggaacaaaccaactccgcaaacttgtccgtcttgtgctgaggagtcggcttgacaccacgcatctcgtagagtttgacaggaatgccacgtttggcaatctgataagcagcttctgagccagccaagccagctcctataacattaatgtgggtttgagacatgaaactaatacctctagccagaatatctgactactgtttgggaatacccaaaaacagaacctttctaaattttatacctatctagtataccagaaaatggctagaaaggacaaaactaccttcattgaaatgaaagtagtttcacctttttacataatatattttatgtatatcctttactgttctatcgcttatttacaatagctccgctatatctccaacaacctcaaaattccaaccaagtctcctataagagtcgatttcttcctgactatacgggaaagtattcagcaaaatggaatccattcccaattcatgagcaatagctatatcggatgtcaaatcattaccaaccataaccgtttcctcaacatcaagattattttcctctaaaaccagttgaagaaatgctggttcaggcttcttcatcttaaagtcagaagagatataaattttttccatcaaatcagcacaacctgtctgttcaatttctgcctgagtaaaaattcgttgagcattggagagaataaataatcgcacttctctgtcctttaatgtctgtagactagttagggtattttcataagcctctaacttttcacgtgaaagcacgcggaaaatcgtggctactacttgtccaaaagtctctaaatcagtcggcttattggtactttggttttcatttggtgcatccgttaatagacgaatgaagattgtttctaaatcaatttcgacatactgataactcactgtttccgcgagagagctctctgcctcttctacaaaacgatgataggcatttttcaactggcgcggtcgataggaacaaccaaaagcattgtaaatctgtgttagctgattccagacctctagtttattctcatctgtacgaatatcaaccaatgtaccataaaaatcgaagatatagtttttgtaacttttcatgtctttctcctaatctttagacatcattttttatattataccccacaacgaaaacgtttgcaacaatagaacgaaaaaacctaccacattaagtgataggtttttattttgattggaaactctattatttaagagtaacaattgcacaacctgttaaatgtgcagtatcaaggggtttgagttcttaatttgaagtttggcaggaattttggcataaaattgaatccaaccctgcacttttaatattttgtgtgatttcttcagaaactgttttatctaaagcattaaaccaatgactatatgtgttcaaagttgttgatttatcagcatgccccattcgtcttgctacatataaaatatcttttttcaaaacatttattagataagaagcatgactatgtctaagacctttccctgttataacaggcactcctacttgctgcgctttacgtttaatgatacgacaaatggttgatttacaaaaaggatctccaaatcttgaaatgataaaatctgtatcttgatttgcaaactgattttttcgccaaacttgaagtacttcaatagttatatcatccaattcaataagtcgttcacctgctggagtctttgtttggtctttacgataccaatttccattttcatctttctccaaggttgtatgtacctttagaaattttttatcaaaatcaatatcctcccaacataaagataaaccttcactcactcgtacacctgtcatataatataaccagatggcagtaaatcgttgtaattcttcataatcatgtaagtcaaatgatttaataaatgtctgaaactccgcataggtccaaaatggagtttctggatgcttacctctaggattatctaatgctttacaaggcatatctgaaatatagccaagtctttctgcataacccatacaagctttaaaccttgaccataaatttttcgcatagttttcagaataattttctatgatatgcaatctaaaagcctcgcaatctctaggagttattgcttttaatggctttgaaccaaaatattgaataaaaagtttatgatgaggaagagccgtcttatatgtcacagactgaactttttgcttatatgctcttaaataaattgtgttcatatagttttcaaaagtcatattgtaattttctaaatggactttgttggcaaattcatattttatacgaactaattcgtcatatgcttctttcatcgtttcaaaagttttaccatattgattttttctagctttcttttgtacccttttgccagttactgggtcgattccaagatcaatctgataaaatatctttcccttattatcacaataaacacctttgtattttttactactttttgttgccatttggattctcactttctaaatgttatttagatagtggaatccctattaattgttccacaatttctgctggtgcgatacctagtcttcgattgtcaaagggcgatttacttaattgtaccgcattatggtcaactttgcgagcttcttcaaacttttttacagcaattcttttagcttcacgaataatgtctctagaggtatgttcaggaaatcctaagttcattaaatctttatatgtagcagttctcatacacttgcctccttcaaatcactaagtttttttacacgctagatgggatttgaatggttagttcaatcatgggaatttcacccgctgtccttttacgatggcagcctgaacggtcagaagtatcattatcattatttgtgtcatggcagataggttaccatcctatttttgaataaatgattttcgctcatttcctggcgcattacattctattgctcaacaaataaataaagtcccacctagaattattcaattgtcaatgaacaaatcaggagggactattttttattttttaggcggtagggagtgtctgtaagtccaagtaaataatccgtactcacttgatataattctgagatttttatcaagaaatcaacaggaatctgacgtttgccagactcaatcttagaataagctgactgactacatgataaatatcgtgcaagatactcttgcgaataatcacaatcctctctcagatccctaatgcgcctatacattcgttcactcctaagaaaattatagtcaagttctgaacgaatcttagtttttattccaaattggaataagtttttgatatagacattactatttcatatttactaattaagccatatctccataatccaaatcacaatcagagaaaaatcattttgaacaataatttcatacactcgtcaaaaataatattattttaatagcaccctatctaatatattcaaatgtgaataaatcaggtatgagtgctaattgttgagattttgaaataatttttatcaatatacttactttctgaacttcatagtattcaaaattacgatatccaagactaggtacagtcactattttttatcggaataattaatttaaccatagccccatttttcttattttggagttgtatatcaccagaatgaatgctcattacttgttttacaaatgccaaacctattccaaaatgttcaaactgtgaatttctactagtatcttctcgataaaataattttccaaaattttctaaaacatcatccgaaaatttggaaccattattccaaatacttaaggaaatactactatcttctaactccaagataactctgattttctttttaacatcatctgcataagctattgcattattgacaatatttgatactgaacggataattaaatctaaatctaattcaatattacagtctcgccatatcttagtttcatatttgtaatctatgttatctccaataaggtatgcacactcttgttccagtatttttgataaattactgatactatactgatgaaaggaaatctgattagagtaaaaagttttagagtaattaatcaactgattaaaatagttatctaattggttgcttgctctttcaatgtccctaagacactggacatcaataccagataaaggtgcaaattgcaacaattccgagtttcctttgattacagtcaaaggcgtttttaagtcatgtgccatcgctgaaaccttaaagagaatatcctccttttggtctttctctacctgaatcatattttttattctttgctgcattagttcaatatgtttgttagtttctatgaattcgagaatcgttaatttagatgatgtgtttactgaggtcagccacatactaccatgatagacaatctccatttcttgctttactcgtttcaacaaggctttaatattaacagaaactataataatcaaagatatacaaatataaacccatgaaaaaacattaaagaatattcctaacaaatcactagcgattaactgagtttctgaatgaatatcaatagaaatagtcgatatggggaaaatatatgctacaatcacactcaaacaaaattgtttaataatcgtccactgcgtttttttgaccaaagtcttaaaatctagttttcgttccaactatatccgcctccccactgtgtcttgattggattaattgaaaagggttttaattttgaccgaatttgataaatatactcagcaatagaacgaaattgtgcctctgactccgacgggtatattctttcatagagttcctctacggaatatactctcctcgggttgcttgctaaagtatacaaaattgtaaattctcgctttgtcaatgatatgatctcttcttcaatcaagatttcttgcttgctggcattaattatcattttctttgtgcatatctctttattatttttacgatttctctcctccctttggatatgcattctaacgcgagcaactaattctgtaatactaaatggtttttttatataatcgtccgcaccagcctttacccctctagccaaatcgctatccaattgcttggctgttacaaaaattatcggtacatcgatttgttctcgaatggatttacaaatttctaaaccatcaatagacatcataatatctagtaaaattaaatcaaagccaacaaatgaacaaatatctatgttacctacttctttccttgtcgtcacttcaaactctgagcgttctaaagaattctttatcaaacgaagaatactttcatcgtcatcaattgctaatatttgatatatttttttttctttcataattaaataatatcacaaaatacaaaatttttatcgtactattctcttcctaaactgcaaaatagagaaagacaacagcaaaatcccccataaaaattgaattgcaatacctattgtagaaggtagataaggttgattttcagtcgtaaaaaatgaattcatggtagagataatcgggaagtagagaaaggcatcgctgaattgcagaagcatttggcctaaccccaacaagaaagacaaggatatccccattggaacaactatactccttgttataagaactaaactaaaacatattaatattaaaccaattgataccagcattattcttactgcaatggtataaataaatccgggaattaatagactataaaaaatatataccacaaaaatagtacagacggtaactagactccaaactaatacagatattgataatataactattaattttataaaaaagaatttccatcgtattgggttagctaataaactgcttcttaaagttgaatcgttaaattcttgccctataaatagtattgtaataataataatcccagcttgtccaagatagaagctttctaagatttgtgttaaagcataattctcggttatataacttggagtttcatgtaaaaaaataacaaataaaggtactaaaattatagttgctagtacagtcaataatagccatttattataaatgaactttaaatactcacttctaaaagaattcatctaacattacctacatcttccttcaaaaatttgcaatatgcaaagccactaattactagcacccaaatactcagaaataaaacactgcgtcctggtgttgtgattttcaaaggagacgttgcaattaaatcttgccctaaagatactggtaaatacttggcgagctgaattctgtcagcaagaaaactacctaaattatagacttgtggtagtaaaaataataatgatccaagtgaagatttaaaataaaaagcaattgaataggataatgccgttagtagcgaccacgacagtgatcccaataatataaaataccacacattcttattcagtaacaaagggttcaacccctctcttcctaaaccaaactgtgcacttacaatagataaatagattgagacaaatgacacaacaaaaataaatacacatgtaacaataaattttattacaaagaatacaactttatttgaacataatagcaagctggtacgtaaagaactatttttatattccatacttccaagaattgctcctaaaattatcatagcaaacaagcccaatagtattgcatcaaaaccaatatactcaattggaggtattggttctgctaaactactatttgtttcgggtgttgcattcaatccaactgttaaaatttgtttggaactgatataagacaataacggctgaagaataaaaacaattggtaaaactatttgggttgatctgctataaaaaattttatatagctctgataaaatattatggctttttatactactcatcatagtcaccccctgttaaatgaaagaaaacatcttctagattatcaaatccgttcattatattattaagtgtacccgaagctatgatgcttcctttattaataaaaacaaccttatcagttaccgcctctacttctgaaagtatatgtgatgataacaatactgtcttaccagcacttgcttgttccctaataaaatttctaaaccatctaattccactaggatctagaccatttgtaggttcatctaaaatcaggtactgaggttttcccaacagcgctgttgcaatacctaacctctgcccctctcctaatgaaaggtttcctatttttgaatatcttttatgttcaatatcagtaatggataatacctctgatattctggataaatctattccattactagcagcagcaattttcaaatgttgaaaaactgttcgatcattgggagcccccacaccatcgaaagaagctcctacagttaaaagaggacgttcaaaatcacaatatttcttacctcctattaaagcagtgcctgaagatggcctatccagacccaaaagtattcgtaatgtcgaactttttccagcaccattcggtcccaaaaaggcagtgacttccccctcttcagcagtaaaggatacattctttaatatatctccatctttataagtttttgttacatctcttatttcaatcttatttgtcataatacgatactcctatactcctatactaaaaattgttctttggccaactctttatataatggaacagattccaatagctccacatgagtcccacttcctacaagtcttccgtgttccaaaacaaagatttcatctgaatctaaaattgtagataatctatgagcaaccattattatggttctctcacctctcatatttttgattgcttccttcatcttcttctcactaagactatctagattcgaagttaactcatccagcaagagtatctttgcatcagaaagtattgctcttgccattgccaatctctgtctttctcctcctgataaattgaaacctccttcaccaatttgactctcaaccccagatgcacctctttgaatcaaatgctccaagccaactttttttaaagcgtcacaacattcatcatatgttacattagtattacccatttttagattttctaaaattgtaccagctactaatggtgagttttgctcaacataagaaatattagaacgtaaagtctcgcgactcattgttcggaaatcttgtccaaatacctttatactaccactagtaatatcatagaatctttcgatgagataaagaagtgtgcttttccccgcaccagacggaccgacaatactgacgtaatctccactatttatttcgaaagtaatgtcctttaatatataattatcatccgattgaatatcctgaaatttgtaagaatcatatgaaaaagttacattcgcaaattcaattgctttgcttctatccgacttagtttctagatttaaaatgatatcattatcttcttcttttggaagatcaataatttcagtaattctacctaaagctcctaaagcttctgaaatagttgtgaccgatgaaaatatttgtcctactggtgaaatagcgatatacattaatagcataaaagaagttagacttgcaatagacatttgcccagtagaaacacggtatcctccgactcccaaaataattatcccacacaactgcaagctaaaatttgatatcggtgtcattattgactgcactcttgcaactccaattcccaagttttttacttcttgtacctcagataacattttagataattctgaattcgtttcatttgtcgatcgaattgttctaattcctacgattagcctatttaagtatgctgtcattttccccaaaccctgatgagctttataacttgctgtttgaatcaaactactcatcaataaaataaataggaatgataaagatatggaaataattgtaattattgcaagatatgtatcctttagaaataatgtaaatatcgcacctaaactcaagaacaatccactcgtcagagcaacggttgattgaatgattcccgctcttagcttacttgtatcactgctaaatcgactaattaggtctcctgctgacagatcattatatttataaatgggaagtttaagaaattgaataattaaattttttcttgattgaaatactgcactttctcccattaattgtaagaaataatattgcaaactggaaataatagttgtacccacggtaatagcaataagcgtatacatagtggaattattgaataaatttactcccttttgagagattactttagacaaaagttctggctgtaataacgttaaaatggacgtaagtattcccaaacataaaacgattaaaaaatattttcttttattttctatcaaggcaagtaaatcacggaattttacattagtcatagtatcatttactttttctatatcttcagttatcatatgtttacgctcttcatttttatcatctagagttttcacaactctttcatacgatgatacttcttctagctctttaatcggatttccattgacttccacccatgcatgagatctaaaggggttcatagcaaatccagtacaccaacttgcacgtttctttaaaagaagtaagaacattattactcctaatgatctttttacgcatccatcttgattcctacacttacggcttacagtacatattgcatcacgagctaatacagcttcatttactgttgcggataattttgagtcacttaatttattaatcaaaaattcaattcttgtaggcgagagctttgtaagcggataagagattagtaaagctatttgcgctagtaatctgtactttagctgaacataggagtatgactcttgattgagctgcatatccataatctatatccctcctttttttagagactgtataaaatctttaacatcttgttttgcaacatcggtttcaatggaatactcagcagatatagcactaactatttcttcttcatttttatttttagatagtaattctaaaatattaacccctacatcatttgtttgaaagtatatcccttgatctttgtcaaatacaattgcaccattgtcttgctttattatttttaatcttgttttagatcctttattaaacatagttacaaacctcactcattcttcatatacaatttaatctgcctaatccaacgttctaccgaacataacctttcaaaataatcaattttattcggatttcccgcaggtaatgacagctccaattttaacttttcaacatcaacaattcccatttttaccacttcaaattgttctaacttgtggaagtttttacgaactgcttctctatatccactatataaggcatctgaataatcgcctttaaaacccctgttgaaaacttcaattggtacgatccccttcaatgctttttgcaataccggttttgttagctttgaactaactttatattttgctggaatttgaagacaaatttctactaattttttatgtaaaaatggtgttgcccaataaatggaattagtagttaattgaatttgtcgcaacactgatttttgaaatattaaagattgaatcatttggaatgttgttctatcagtgattattggctcagaattggaaaataataacgagtttaaaaaactttgcgattcttttttggatttttcactgagccaacttggtacctgtagtccatccatccaccccagttctcttttgataggttcagaagattcgttgaagacaatttctaaattttgggtcatggtttccaaatatcctctcttatctaacaaatccaataggcaactaaaaaatggtcttctcattatcaaactatatttcagagcataaagtagtccacctaaattttcctgacggactatactccagggattagaaggcatcggtgtgaataattcatcaccaccaatacctaggaaatgagtcggatgttttttaccttcctgataagtaatcactgattttaaatatccttctgaatcggcccacagtaatggaaagcttggaataataccattgatatatccttcttctattgcaaatcttttctctgttatttctatagagtcaaatttttttaactccctaccaagattttttgcaataaatgtcgcccatttagtatcactattggcagtagcacttgattcagcatgcaaaatagagaagtccggtatcattttattcagtgtaaaagcaattgtcgcagaatcaacacctcctgatacatcacttgacacttcatttcccatatttagatcatgattaatgctatttaaaaactcttcttttattttaattattagttgattaaaatctttagtgtctacttcataacttggaatctttttttctaaacaacctttttcggttatttctaaatagtttaaaggttttatatttactagctcttcccagaggctaattgtttgaaatggataatatggaagtccaaaaacaaattgactcgctaaacgcttcgtggaaagttttaatttcagatattttgcaatctctacagcggaatcactaaaaattatattcttattattctcaaaccaagatagtcttgaatctaaataaggagaaataatgtatattctttcagccatttcaacaataattagaccatttataacatgatcctgaagtactgatattgtttcttcaaaactactgatagcattctgttctataattgagcatacttcttcgacatagccttccaaacaatagatttttgttttatttacagaaacagttctatataaatttttagtaaggaatattatttttttatcagaatatttttcaaaaaaatacttatttaccatatatattaacaacctcaaaaataaaaaacaaagtatctcgatattcgtagttctggaatgaatatcgaaatactttattcaaaattatttaccgttgtaatacatagttctaagcttagaactcaactgtaacttttataagtgcacgtccaccaaagacatcacgaaacttaccagtccatagacctttagtgtcttttttgaaagttgcaattgattcaaatgttggcttgcaacatttcattttaaactccttctatcatttatactaatgccagaacccattgatataaatgaaaatatttttcaagagatatctcttgatttaattaaattctataatataaatttcggaaaaatatcagaaaatagattaaaattgaacatattcggatatttttcacttccactccgtggatcacttgatttccacaataattaatatatcacttggcaatatatctgggtaatataattatattttaattaaaaataaagccctgcctccaaatatatctctgaagctacctgcaactaatcctgcagtaccatttttaaaagtagaaattttttctataactggctttgtataattcatttattttcctttctaagtcaatttttaatagtccagactgtttgactaatgaaatagtaacaaagattattcagatttttttcagaaaaattaaatttataaataattactgatttaagcaagcttattttatatttgaaacaaggataattcccaacaaatgataaagttcgagactctcttcttgttttgtttaactatcgccaccgacaagctccaactggtaaggaaaatctccaaagtttcgaaattcatagccctgacaatctagatactctcatatcaaacctgataaatgattaacactcagtatttcaactgagtgtttttttagtatagttccttatcataatcctttcttgttctaggagctgttctattcaacaccgccacaaaggtttccagttttctgacggattcttcatagttgtcaagtaacttactgagttggtcttgagtgttagaaatctctcgttcgatttgctccaaagttacactttctgtcagattgagtttggaaaattcataacgtgccaatcgcctacgttctatatcgtgacttttgagattgactaagacttctgccatcttatttaaggtggcgtttttttcgttgagttctgacatgctaacatcgtacgtcgcaatttccgccaccaactcatctttaatgtccgtataagctcgatttgtaacattgagttcaatcaagagattgacttcagcgattttctcctgtaactcttttagatttggtcgcctacgataaggcaagcttttgttgtcttgtgtcagctgacgaatcaagtcacgccctttcatatagcggttcttatccgaaccttccttattgtagataaaatatgacgtgatttctcggaggaaaatcttaaacctcttttcctcctctttctcaatctcatccagctgataattaggaataaatatcaagccctcttttttcacaccaaaggctaccttgatgaaaatgccaccctcaacttctttgtcaacctgatgcggggcaagctccacctcaaactcatgaacagccttacgattttcggagaacgtttcatagtctgagacgatactttctactgttgataacttctccgtttgctctgcgagaaatatttcaaaatcttccttgatattatcactcagctcaatgtcagtatctgaccgttctgaaaaataatcttggaagaaagagacatcataaagctttttcttgctcacttgttgatgtcctagagaaattttctggtcattttccgtaagggtaaaggtcacatttttctgtttgagttgaataaatagtccaagttcctctgccatttccaataattcttgtaaagttttcactctaggcaataaaaaatgtaatcgttgctcaatggcacccttggcaaatgcttgtcggaaatagctctcatcataaggttccctgcgattaagctgtcgcccgcgaatgggtttgacctgatctctatccgtcatcaaaaaggtagtatgcttgcttgagaagtcaatagtcaaatgcagctgctctgcttttttcaaaaagtcctcaaaatccttggactgttccatcaaaaaatacaggcgttgcttgagttcaaacttatgattggtcttgcgataaacgtcgtactgctgatgtgaatagcgattcgtgataatttttgcaccagcctctttggaaatgcggtctgaaatcatacgaagatttcgttccaaggcatagttccacttgagctttttatcagattgaaggtcaacagaattgattaagatgtgattatgaatgtgtgactggtcaatatgggttgcaacgataaaacgaaaatttccgccagtaagttctttgacagtctcataaccaatccgattgatctcttcaggtgttaacttatcgtcaggcgaaaaggattgaatgaggtggtgggcatgaattttctgttggcgtttttcttgtctgtcatttctggaatcatacaagccgtcattattcaaaaaattggcctgatacatcttgaccatttcctcataactgggaaaatccaggtaattactcatgccaaaatctgaaaccaatttgagctgggctgtcttttctgggttgagaatgtagcgaattaggttctttcgatactttcgactatgtgtggcataatgcttagtgatgaccatagaaatcccttagctgttcagccttgatttgaaaatctttctccacttccgataccagctctgccatcccttgacctaagccttgaagctgctccatagaaatcagatgagtctggttaatgacacgggcaatctggttgacgttgttgcctatccgccgcagctcaaagaccaaatcctgataagtggtcgtgtcaattgtgataaaatttctgttcggatcaagtaagacttttctggcatactctgaaaaagttttacatctgctttgcgaaatacagtcattaagctgagccagttccctatctgtcaaaaacacttttttgaggttagtgcggtagcgataatccattagcgacctcctatatacttctcacgaaagtctggactgagcgggatagacttctcgacttctgccatcagttccagcacacaggtcaaaataatgcgtagatgttcagaggtgacttgttggtattcctccgcaaggacagtcacttgatgaatgtctcggctgatttcttccaatttttgagactgccatagagaagaccaggtctccaaaatgtctttttggcggtctttttgtaacaagttttggcggagaaaatctgaaaaagtctccgaaccttgctctttcatcatctcttttagcaatatttcttcctgcttagtcactcgaaactgcttacgaattagctttaagtcttgactcatcttaacacttcccttccattctgcttgtctaacaatgtcaggctgcctcacactgtcagtacgccctagaaaagcctcaaggtgtcccttttcggcttttgcgagctcagatattgtgtccacaatatcccaaaaatcatatcgccagctgactaaaactctccagttttgacagctaacgataagataatttggtggccccgcccccaaacccccagtagaaaatcaagtctttattttcttaagaatgatattaggataacaaggaagatttggaaaaggtatcacaactaatacagttataattgactttcttaaattctatgatacaattcctgtaaactgaatatttggagaaatagtcatgctgaatatagaacaattagatttactacttaatactcctgaagatgagcttcatgatttcaaacaaaaatggcatcattcaaagtctgaattagttcgtgacatcttgaattttgttaatacatcacatcacgaagattgttatatcatctttggaattgataatatcactttagatataatcggtttaaacaatgatgataatagaagaaatgaagaagatctaacagatttactacataaactctttatatcaacaaataatcaaattaaaattagcatacaaactgaaactatagacaacaaagaaattgacatcttaattattcatgatactgataaagttcctgtatttttaacaaaagattataagcctaagaaagatactgcattaccaaaaggattaatatatgctagaaatggctctataaatactcctaaagactcctctgctccttttgagttaataaataagttgtttcaaaagtttaatcataccgacttaaatatcaaagagcagtattttcatgttttaaaagactataaaaattggttcttcattgaaaatgaagacggaagattttttatttataatcctaatcccgatttttatattaaacttaccgacgatgatgcaaatcgtttcaaaactatgccttatagtttaaatcaataccaaaccaatgttgattggcaattagtacaacttcgttatcgacaccttacaattatcgactttagggctttatatttagatcagggaaattgtctagtgccctcccctgatttagaaagttttgaatgtggttattctgacactatttattaccactgtttatacaaaacaaagtataaatttctaattatctttttatattttcttaaatgctcgtaaagccttattctatgtgctttcgagtatttttactgtaggaagatacttcacgtttctttgcatatttcctcatgtcttagctgtcagaagtggtaaataagtagtaaattcatttgtactactaagcaacaagacgctcctgttgcttctctttattcaagcgtttcatttctgccattgcagaatcgaatgttgcatgtgcgtaatagttcagcgtcatggctatattagcatgtcccataatgtactgtaatgcctttggattcattcctgcatttgcatagttggtacagaatgtatgtcgcaaactatgtggagtgatgtgtggcaatttatcctcgttatacttattgtatttcttaacaagacctttcatcatgccgttgtaatcacttgccacttttggatagttctttctattaagaaagaggaaatcactatatccatcaatctcaacacgcttatcattctttcgattcgctaacactcgcttaaatgcttgataggcttcttcaaccataggaacttgacgttcgccacttttggtctttggtgtttcaatgtagtacccaatttcagtatctctcaatagctgatggtctatattgacaagacgattctcaaaatctaaatctggaagtgtcaaaccaccaaactctgaaatacgaagacctgtttttaagagtatcagaatttcatcataatttttgctgtaggttttatcagcttttgcaaaggctaacagtttttcttcctgttcttctgttagtacggtcttagggacagtatcatcatcaagaactgctttcagttgaaagtcaaatggattcttccgaacacaatcatcttgtatagcaatatagaatgaagcctttaaagaacgtttgtagttattgatggtttgataagcataaccattttcactcattctaatagcccattctttagcgtctgatggcttaatactgtcaatacttcttacacctaacttgtctttcttcaaaatatccataagatatttgcgtccagtttcagtgttttttctaacctttggtctttgagcgttctgttttgcgtaaagctggcagagtgtcattttctttcctacaacatcaataccatcatgaatgtctttctgtaactctgcgattttctctctaagtgagatacaatcacgctttcctgctggtactcggtctgtagccacaagtttccacgagtaaacaaattgcggttctccaaatgaatctatatatttgtataagtatcttccgtcttttcgttggctctctccagtctttaagattcgacctttattgtcacgtcttttttctgacatggcatttgctcctttcctttatggaaagagccttgatacgacttaatactattttatcatatacaagaccctttggcgacgctagattgcgtccaatgtatctataattttttcaaattgttttcgtttaatctgaatacgattgccattcataatcagccaatttgcatttttattttcctctgccaagcgtcgtagcttgttttcgccaatacgaaaatattttgacgcttcttcaatggttagggtataacgttcccaaataggaatgtcagtctgcttcataaaatcctcctttccaaatcacttatttggatttcataaaagttgttttaccagcaatcgaacagctttagcaaagctcacgggagttccacccctgcatggttctcatgtagccatactcattgcctgcgacggttttatcacgctcggactattgactgtatgggagtatcattatcacgataagaatgtcgttgcaggcaatcctgctaaagattgcttctcggatcactaacatgaatcgctcgctatctttataagataggtcatggcggttagttccgttggctcttttcttatcgaaacgtattcgattacttttattcagttttcaaagaacaatggctcgttagcctatcaaaacacattgaaagctcaatatgctttggtggaataacaaacctccctgttcgggaagcgtggaatggtttagcacgcttccacgaaaggagagaggatattacttaatttcaaatgacaaaatctttgtaatcagtctggtttccattcttccacgtaagacttcatcaacgaccatactttgattgccatattcatctttcataagtcgtagggaacgcttcgttatgtaccctctgtaatgatgtagaatctggttaatcgcttcggtatcgccatctgttgcctttacaatgagaggaaagggaatcataggatattgtgttttcattcttcaaattcctccataaactttttaattaaggctagtccactggttctatgccgatagacagtagaacggttcaatttcaacaggtctgcaatttctgaatcgctcatgtccataaagtaaaacagcagtagaatttcacgtttcttgtctggcaactcacgtaatgcttcactcaacaaatcattttcaacgcctactgataacccattgagtgtaaaaatctgaaagtcagttgaatagttatctgttgtcgcaaactggctaacaagataatcgccaacatccgaaaaggacacctcacgctttgcaatccttgaaagataaagcatataattctttcgctcgtcttccatagcacgtttacagatatagtcaaactgattttctattgtggtctgaaaagaagatggtttcatgtttctcaccccctttctgtctaggaaaggaagtgagccttgctcgtttatctcctttcactcttagtcccaatgtgaaaggggatttgttgcattactgataaataaactttgtaaaaaagttctgaatagccaaaaaagcatataaacagatttatttctctgtttacatgcttctgttattctatctatatgatttataaaaccacattggtggacgtacttatctattgcagatagacgactttttttgacaagaacccaatgtaaggaaatttattgtatatgatgtacttcatggcgacgttgacctccaacaaaccgccatttggaagtaatatacaatattttaacagcgtaaatagcactaccatataacggttttttttattggcgtttagtagtgctttttattaaatataaacctataaaccatataacacgtttttctatacctgtttttaattcagtaggaacaataaaatgtatagaggtggtctactatgcgtaaaaaagaagataaatatgattttagagcctttggtttagccattaaagaagctcgattgaaacgaggtttaactcgtgaacaagtgggagcattgattgaaattgacccacggtacttaactaatattgaaaataaagggcaacaccccagcatacaagttctttatgaccttgtatcgttacttcatgtttccgttgatgaatttttcttacctgctaataacttggtaaaaagcacccgacgattacagatagagaaatacatggatagctttacagacaaagaactatccttaatggaatctttagccagcggtatcaacgaagcaagaaacatcgaagactaattaaaagaatccatacataacggaaagagccgataaaatgagattgtattaatctcattttatcggctctgcgtctttgcgtctggctctgtaatcacagttactttgaactgctttatttcaattaaattttcttgtctgcatttcggacaatagagggggaatttttttaattcagtatcttcccttatctttaatcgtgttttatttccacatacaggacacaatatccacttgtagtttataataactatctcctcctttacactttaattcaaatctttattaaaaaatatttcatcttatttaacaagaaaccatatttatataacaacataaaatacactaagttattttattgaacatatatcgtactttatctatccgactatttggacgacggggctggcaaacaggttcaccggtagtaacatggtacccttttaactctgttaaacaaacactacgtccatttgtaaagaaagttaaatcactacgatattcttgaatacaccgagcagggatttctccactaagaatgacctcattatttttcaattgagtgtctacgatgttcgcacaatatttaggagcatcgttgtatgctcgtgaaagatattcctgtggcgcataaattttaaaactaagatatggctctaacaattctgttccagctttttttaagacttgttccaatacaataggagcaagcatccgaaaatctgctggggtactaacagggctatagtataagccatacttaaaacagattttacaatccgtcacattccaaccatataatccttgttcgcaaccatagcgtatcccttccataactgcattttgaaatgattgatttaagtatccaagagaaaccgagctctcatactgcattccacttcccaacggaagcggtgatacagataaaccaatggaagcccagaaaggatttggcggcacttcgatgtgaatggtatattctgcattttttaacggtctctccatataaatgactgtaggctcttttagttctatctccacatgatacttttcttgcaacagtgcactaatcacttccatttgtactttccctaagaaagaaagtataatttcatgtgtcgtagaatccacataatattgtagaagcgggtcactgtcggagatttctaaaagtgcatcaagtaacatttccctttgttgaggtttgctcggttcaacagttgtttgcagcagagggagcggattttcaattctctctctctgtggcaatagctttgtatctccaagaacactatttagcttcaaaaactcattttgcaaaataacaatttccccggaataagccttatcaattttacataattcaccatttattgaagtatacatttctgtaatttttattttttccttttccgatattctaaccgaatcccgcaaatgcaggattccgccataaaggcgtacatatgcaagacgttgtctttcttccgaatattcaattttgaagacatttccgcaaagttcagacttctttctgtatgttgatgaataaaatttattcgttatcacttctataagctgctcaatccctatgttgctttttgcgcttccatgataaacagggtacaaggagcaattctgaaatcttctgatttcctcttgttcgagttctaatgcttctaatgatttaccggacatatatttctctaaaaggtcatcatttccttctattaccacatcccattgctcaggttccgtacagctcatcacacacatattagggtgcagctctactttctgtttgattataatttccatagaaagtttctctttaatatcctgataaaccgttgataaatcaattccattttggtcaatcttattgataaaaaagattgtgggaatccccattttcctaagtgcatgaaataatatacgagtttgtgcttgtacgccatcttttgcagaaatcagtagaattgctccatctaaaactgataatgaacgatatacttctgctaagaaatccatatgtcctggcgtgtctatgatgttcaccttcgtattttcccactgaaaagaggttattcctgtctgaattgtaattcctctctgacgttctaaaagcgtattatccgtcctcgttgtacctttgtccacgcttcctaattctgtaatcgctccactgttatataataagctttctgttaaggtagtttttcctgcatcaacatgagctaaaactccaatattaataattttcatgtgattttcctccattcaaaaacccaaaagggcataaaaatcccagtgataaatacttttatcactgggatttttatgcataaccataggtatacaaagcatacagatattctctggatactttagaatcacatgataaaggtattcttaaactgggtacaaaaaactaagccctcctaaaaaaggacatctaattatttgttcctgctatcaaattgacagtttatttaagaataccttgccgcatatttattaactccttttaaatagtcacttaaataatagcacgtaagagcatatttgtaaaggaatctccaattttttatcaaaaagagtacatgattacaaagtatctgtaatcatgtaccaatatttgttattttacaatcttccaattactcccgttcttttcaagtaccaaatcaaattgagatacctgcgttgctttggtctgctggtcgatatactccactgtcagcgataccgtgacttgattatccttacgattgtgaataggatttaccagttcttgaaagatgtactcttttccgattggttttaatatcccgtcattcacatagtaggaaagttcactggctgtcgctgtaggatagagcttgaagaacgtcgttaaaaactcattgatttcattggttgtaatggaatcaaccgtcccctcactttcaatggcttttggtttataacttgatttcttaggtatgttggtaatggtcggattcttaaccagtaccatatttccagaaccatctacatagacactcactatataagcagagtggacggtctttgtattttctccctctgtaatgagctggtctacactgtaggttacattaaactcattgtcgccagttggctctaccgtccatatctgaaatcctcttacagaagacgatacaggaatatctttgcgtactgtatcaacattgagagcttgaagttcatctgtcagatagccttttagactttccattcgattatcaatggacttatcggattgctcccatgaatagtagactttcgcaaagttctctacaaaattttctacatgatgagtatcaacgtattccttttctatgatagttgtttcgtgaatagtatgagtatctatagctgtaaagtgcttgaatatcgcaaagctgaaactaagccctaaaagtacccacaaggcaatcacaacctttttatgaggattgaccttatagacacgaggtttcttttcctttggtatctgtttttctttattctgattttttctaaatttcatcattaaatcttcctttctcattgtttgattcgtcctgctcccactaaatgctgttgccagtaggggcttgttaagtcggcataaccgattgggtcgcctgcatgaaacatacggttattgccaaggtatatcccaacatgagtaatataagagccagcgttataggtagaatgaaagaaaaccaaatcgccagcttgtgcttccgatagtgggatatgctgggtcacatcatattgctgttgtgcggttcgtggtaagttaattccagcttttccatacgtccattgtgtcagtccgctacaatcaaaagaagtagtcggggaagctccaccgtaaacgtatcgccagccctcatatttcagtgcttcgtccatgatggcttgtaccgtatcatcatcaaactctgttgtgacaagatactgcgttaccagttgcacataaaacatattgccatagttgtatcgccagcccccattgataggtatggctatgggattggggtaagacactttttcgccacctgaatactcttttgagaaactttgagccagttcaaaggtatatttatttccacgattagccacataccctaagaaaccaccaccataattgtaggactggataaccgattctaaatctacactgagcctttcgctactggctaataattcactgaaatacttcacaccttgcttaatggattcttctgtactcaatgaattaggtggaagaccgagggattccgaggactgcataacatcttccgcagtaccgcccgattccacctgtataatcgcaagaagtatgttgacatattcttcaacgccatattctttggcatatttttctaccataggcttatgagccagcacttctgcggaaacattcacacctccataatgaatattggaaattccgctgtcctgttcatctgaaaataaaatggcaacaaacagaagcagtgagaagaccatcaagaatagcccagaaccaccaatcactaaagttttcaacttcatggtttcttaccgactttcttaatggtggcggttttgattggtggtctacttcttgtattttgtagtggtactctttgaacagtagacggacgttcttttgtgattggacgttgtgaagttctatctgctgtagtggttgaagttgctggcttttgaacggttttttcttgaacggtattgccttggcgttccacttttggacttgaaaaatcggacttaactgctggacgctcttgtttggcttgttgagattccttatatgaagtctgaatattagactgttttgaggtctgttcatcatgatattgttcttgtcttgtagtcggtctttcatgaacagaagaagcaggctgttttttctgtttgacctgttccatttcagagcgacgcttcgcaatggtttttcgcctttgttcctgctgttccttgcgtccactggctctgtccgctttggtttgagaaatactactggttaaatcacggacattctcttttactttggattttccttgatatactgcatatcttgcattggtcggcaaatctttaacctgttctttcaaaccactagcagtgtctaccattctgtctttggtatcagctactgtaccgatggtttgaccgatacgttttccaagtgttgatttttcctttccgtctggtcgggagtgatctgcttgtgtccttgcagaactccccgaacccgactgtccttttttacctgtaacaatggcagacccagcccctagagtagtcatggaacgtccaagtttccgctgtagacggtgcatgtgagcgtgcataagcatacgaggttttctcatcacacgacttcccacactttgagaatcgttactctgtagagaaaacatactcattaaatcgcccagcttgaagtagattcctgcaaaggtcacaatctgtagaaaagcaatcaaaaagaacggataaccagccgataaggtatagagcatggttgaaatactaaatgctgtcgtaataatcaatgtgattccagctcgtgtcaaaatggtattaaagagctttgttatggctcgttttgacataccatcaaatgatggaatcatgcttaaaataaagctcacaggcagaaacatagcatagatgataaaaagtacctgcgagaaaatcatgattcctgttaataggaatacaaatatggaaatcccaatattgaagacaaataggaagaagactgtacctaaacggttaatggtctttgtaatggttagattggtattgcttctgtcttcaatttcttccgcaacaattttttctctgtcttcgccattgttggaatctgggctggtggagagcaggctttccacacggtcaataccgatactttcaatgtctgaactgttgtattgaagcagtagccacggttgctgaacctgtatggaaaacaggctatctctgattaagtccacgctgtccttgccttgactatcggaatggggcatgacaatcttcgtgccaagtgataaactggcattactgatgtctgatgaaaagtcattgatttttttaatgtagtcgggagcgtaggcaataaaggaagccgataggataaacaccagcacaaaattcataatggcatgaattgcctttgtggtttctctctttatcagtcccgtataggcaacataaaccccaagaaccaaaatcaagagtaagaggaatccaacatagaaaccctctgttgaaaatccgtttgcactcacaccagctaaggtctgcatattcttaccaatggaatctgctgtagcggaaatgaagtctaaggaataggcttcctgtactaagtaacctgtcgcattggaaacatacaaactgattgtccaaataaaattggtaatggcatatagtccatacatgacctgttttccaatcccgtccgaccagttccacggaagccagccccagctattatccacataaaaatccagttgatagttttcaagtgggtatcggctgtattcatttgccacattgaccgtatcatctaccaagcccgcagcttgaaccaccgttcccagcatggctaaaagaaaaatggcaatcacaagtgtgaaagccactgtcattgccactttacctagacgtttcagcgtccagtttgattttattctgtttactattgatggtttcacatttacacctcttttcgcacaggtggtctggtatcaaaggcatggagcagttcttcaaatacagggtggaactgtatcacaccgacacgaccatataaatcactgataaggcattgcccgttttccaaatcacgcaatcgcttctgattgttttcgtcctctgggtctacaccaaaaaaggctaaggtctttttaatctcgttaaggtcagtggaacgaaatgcaaattttaagccgaggttatttttcagtttttcatctaagaggtcgtctgtattttgggtcacgaaatataccccagcgttcatagcacgaccagcccgaaccagcttcatagatagtgtttttccttgtgctacctgtaaaaagctccatgcttcgtctaaatctacaatcttgaaaatgcttcggtctgtatggataaagtctaaagcaaaggtactaatgacaatcagcatagcaacggataaaagctccatagtggtatattcctcaaaggaagtttccttgtcgggaagtaccaagtccgcaacctgtataatgttcagttgtttttctaagctgatagactgctccacataaccattactgaataataaatgtgcaaagtcatagtctgtaaaactttcgatatggtcggctatactggtacttagtggcgtattctcaacccgtaattcctcaatcactttcatcaaccctcgtacttcactattggttactgcacgaatggcttttctaaggattgggaagcgttccccatcacgagaggaaatccccgtaaggaatgtcagaatatcaatagccagtgattcagaatctttgggatttttcataatcacataagggtcaagtaagcctttgtttttctcatcagaagtcagagtgacgatattgatttcatgggaaatctctggcaaggtttctttccatctgccacgttctgcttttgggtctacaatcactgcttgtgccccataaagcaccgcataatagacgataaggttattcgcaaaggatttaccaccacccagcgaaccaacaaaagccgacgctaacgcattggttactgaacccttaaccccttgactggcaagagcaggtttcagatagacattgcgtccagtatctaagctgtagccaacataaatcccctcattttcccccagcatttgagtagcaccaaaacctaaaccagcgaggaaatcagaggtcacgtattgaatataatcattcatataacgcttgctggcaggtaaaaattcttcatgtaagccgagcatatccccaaatggtcgtaccagttttacgcttaaatcgtcataaaaatctttcacttcattacaacgacgtttgagttcgtcaagatcatttgctgatacccttaccacataagacagcttgtacatagattccttgctttggtctaaattggtttccagctcattcacactttccagagcttccgccacattggagctggtttcattatcactttgccaagcgtggttatccaagtctttcagttctttctttttattgcggacagtagatagggctttacgattcgctacaatttccacattcattgacgtatcaatcgggaatgtaaattgctgttgctggtagtagaagatttcagaggacgggaagtccagttctccgacaatgctgttaatggtaaagtaagctacatagacggtttcatcttcctgctggattttcaaatatcgctgtttttcttccaccaaacagcgagtaggcttaatcaagtcatagtatttaatcagcgtttcattatccagctttttctttgatagatggtactcatactcttcataggcagtgcctgtctgtccgtaaaggtgttcaatcagatagccgaagtcgtccttatctaacctgcggattttgaaacgacgagagattttattttctaagagcttttccatcttctgaaaacgcaggatttcatcattactcatactaacaaaatcgcccatcagcttatggttcacatcatagacaaaatcagacaaagcattttttgcttcaacggtaagacttttcatagaaaactcctgatcgttgagaagcaacttaaagccgataaagaaacggtagttcacttgattttcgccaatcatggatattaaagcgtctgtctgttggtcgattttgtcataggcaaccgctttgagcttgccagtgacttcatttttggaacgctcttgtgcagaacgtatgctggattctgtactgatttgtaaagcatgaattttgccatcacgattttgtgcgataagctgtctgaaagaatcatgcacttgtattttctgttctggacttagaaatgagtaattgtaaggaacaagctcatagtaagcataacattccccgtctttattccagacgagattgttttcaatgtatttaattggatatgccataaaattcactcctaactgctgtaatggcttcttgtggctggtttctgccaagcgttactttttttcctgcataggtcagctttggtcgcagtgcataagcaatgacagacttcaaaaatccataaggctttttaccatcaaaagtttttgtagacataaaccatgtgaaagccacaggaatcccaaagtatttgagaaatgctccctctatcatggaaagagggggcaagttgccaagtatcatcactgcaaagagtgacacgacaaaccatgtcatttgcgtaaaggttatgggaaacggaagtctaaaatcattgatagaatacagtaccttttccacagaccagatactggtatagcttcgtattttcttcatgtaatcaatcctttcataaaaaataggggtagctgattgagccaccccgtaaaatagaaaatctgccagtagtaatgtaccgacagatttaatagacgatttcaaaaatcccatgattggttgagataaacgttcctgaaaggtctaaatcccgaccataggcttgataatcaatatagttttgaagactagctggtacttcgcctaaagcacccgtttcttcaatgtagtagcgtgccacgtcatacatatcatcacaatcggaatgaatgataatatcctcttgatgttcgcttagttcttcaatgcttgaaaaatgagtgagcagagcagatagctccgattgtaattcttcgggtaattccgataccatttcccatagtcgattgagttcgccaatggaagtgtattcgtcaaccgtaaagggtaactcgtagtcatgaatggcgtattcctcatattcatcattcaagccgattttctctttgacttcctcaaagtcaatgggaaaggtaaaccacgcaccgaccaattcgccctcattgtatttgcctaaattcgcaatatagacttgcatatcgtccatatattcacgtcctttctttgtagagattcaaaaatccctaccgcacttcgtttggtgtaccattcctttgcggaacataagaaaaccacttatattccacaaaagaacggttttatttaagcaccaataatgcgattgaatagctctagtaaaatgtcttttactccagcagcgttgaagactaagccaaccgcaataatcgcaataattaaaaagccaatcagtttgctaaactcacgcttgaagccaagatacaagccaatcacaacgattgctaaaagcaccagtgattgagcgtttgatagaaaccagttataaaggttttgtccaaaattcataaaaatgttctcctctctatattcaatgaatttgtatttgagttatttttttgttgttatcacgtcctgttcttttactgactgttgcttcaaaatctgcttgtgtcggtctgtcagtttcgcatggtcgagaatgtcttttacaacctgcgtctggttgatttcatcaagtttaatcgcaacctttaaggtcggggcaacttgatgagatagccagttcagcgtcctttggaaggagtaaggctctggttttgtggttagttttaatcgttcacgattgttcccaataaaccaagcccattcttcattcagtttccaatcagaacgaggtttggaatcgtctttatctacaaaacggatataccgattgataattttaaaggcggtatgctctggattgtcatagacgagtaaatcacggactgcataataggcacgctcatttttcaatcgaatctcaaaacggttttttacttctgcgtcttcaatgggaatatcatttttcttgtactgctcgtagtccttttcatagatacagaaataaacttcactttgtaatgaaccgatatagagggtgtttcccatacattccttttcctctttgcgtaccagttcgccactgcgatagcttttaaaactgcggaagacggagatacattcttcctgttggcacttttcagtgagtacagggatatttaaaatccctgtcttatcgttaatggcaaggtcaaggcgtttcatcacaccgccagccaccaaaacgtccataaagaactcataccagcttctttgttgtgccagaagatagctttcaaattgtctgcacccacgacctttcaattccaccagaactcctttgtccagttcatgggagcaaaggacgaatatgtcgcctaaagcataatgctctgaataagaatagaaaccatagtcctcatgaagaaaataggacagtttcagttgtaagatgttttcgactacctgctgtacgtctgttgtcggaaagcgaattcttacataatcaaacagcatttcaaggggagcgtcgggattgaagcgttccagagcttcccaaagggactgctgtaaatcctctgatggcttgacttttcctgtttcaatatcgcttagatactgccttgtaataccagtcgcaacagctaaacggttttgagatagtccataagccaagcgtttttcttttaaatgctgtaaccaagtttgttcattcagtaaaaatccctccaatcaaaaaggcgtatgtcaacttttaaagcccatttgacatacgctgaaattttgtaaatcccttgtaaccaaaggattttctaatgtttttttgactgtttcctgtcgatttgtacccccctgttagatacggggggttaagtgctggcgtggctattgccacaccagccagcaagatcagtccacacctgcgacttccgcttcgcacgtcgcctgcgtggactgtctgctgttggataactttttaatttcctccaagaaatcatatccttttggtacaaggggagtataaaactctgatatgacacttgttcctacatcaacatagccacgacctttgattcgctttaagaagaaatccttttgtacgtcactgccaaacatcatgccatagcccatttcagacatacgacctaaagccactctgaaattaaactgatcacggattccgtcgcctaaatattttgcgtctggacgttgacaagccagtattagaaagaagccagcttgacgacctaacatgacaatctgtttcagcttattcataactgcggtgttttcttttgttcccagcatttccatgaaagcgacgtattcatcaaagattaagaagtgtgccgggagacctaagtaagcataatttttgccagtcttatagttcttcatctgcttcatttcctcactacgtttcatcatttcttcatagaatgtttcaatgcaagaaagcaagtcttcttttctatagtagacatttgccatcacagaacctaagtccgcaagatcagcatttttcgggtcaagaatatacagttttgaatctgtatgaagcaaggcttcaatcagtgtcagtataaagtaagttttaccgccacctgtaccaccagcaatcaacatatgagggagcttatcatattcccaccatacgtttttcattaagcgaagtttaccatctttagcttctacttcatcaatagaaatacgactggctatggtgtcatagagcaaagtatattccacataggaatcctttaactctttatccgtcagctcacagtacaagccactctctaatttcttttccaagtgtaagagttggtcttgatattttcccagcgtgatttccacccgtatctgtatcaagccatttttaagtcgataatacattttagggaagtaggttatcttttcctttgtacgaccagcactatctttaaagaaaccctctgttttgacctgttcagattcataccacttgttttcaagtatcatctttgccagtttttgacggtggtaaagttgtttaaccgtatcatagcgaacccgtttgaatacaaacgctaccagcaagcagataagaattgcgacactgaaactgataattaaatagggaatgtcaatcttatctgcttgtgataggttaaaatcctgccagttgatctgctggattgtcttcacatgaaacagtccgacaaccagcaggaaaacaggcaggagtgacgctatcgtaaaatgaaagactaaatctttaccagatgggcgaatccttttaccacgctgtttcatgcgaaaaagtctcctttctacctagcgactatttgtcttgtgtcggttctttctttgcttgtggttgagctttgaatgaactagaatcctttgtcagcacaatatcgtctgccttgatataccagtcaacatctgctccttgataggtggcagtagcaacggtgtccgcaatgggattgataagttccacccgtgcgttataatcaaactctttcaaaggcacgctggcaggaatacttacttgaatcatgcgtccttgtcctttggattttaagtcataggtacgttccttgatttcatctgaaaccgacccgtcttcattttggattctcacttcacgacgtagagcagagaatttcaattctccaaaagtcgtgtctttatctaatacaatgccatttgctaatctcatcatttttcctctctttctttattcttttatcatgtcgtcagcatgtaaaaggtaatttgtaaaaccacgagtgccgattttgtagccctctgcggtaatacgtggattgactaacttcacacgttcctcaaagccgaaatgtttttcgccagcttcagcaggaagcaccaccacaatatcatctgctctttgaacatcagaatagagattatagcttcttgataagacagttagccgtccgttgattcttcgctgaacgactttatcctcgccagcaaattctaaattgccgaatgttttttccatgttgggaatcacaaatttaagttccatatttttacctatcctttcttttttattggctgaatgaatgtttgatggtcttaaagagtggggaacgaccttttgattcttgattttttgttttcataagttcacttcctttcaaaatcgggtaaaaaaatagacacctcattttttgaagtgtctacctattaaatattcaaattttattggaagtatctttatatcttcacttttcaaggataaatcgtcgtatcaaagctcattcataagtagtaaattagtagtaaattgagtggttttgaccttgataaagtgtgataagtccagtttttatgcggataactagatttttatgctatttttagtttaaaatactttaaaataccaattgctgaaagttttttcttcaatatctggtctcgaaaaatatcctttatatagatttaaaaataatatagtaatttatgatgataaaatagaattagaaaagactcacaacttaataaaaagtaatttttcaacagaagagataatgaagcaactagtcgtttcaaaaaaagatttgaatttgtactttaaaaaggggaaacaaaaaaatcctgactataataataaagaaaatgaaaaaaacttaactgaactaaacttaattaagttattaaaaagttttcaaaaaagtatatcttgataatctactatcacattttcaactactcaaacatgcaatataaggcataggaattagtttatttaaaaaacaaattcctatgccttaatcattattaattaccaacctttactagtttagactgggttagcaatgaatatatctcattaatatttctattgttttgtgccctattatttctcaatttacagtatgtgaagattaggtgactttttgctcgtgaaagtgcaacgaagaacgcacttttatcttcttcaggttgattattaaaattccagaatgcagaatcctccaagcctagaaaatagactgcctcatattctaatcctttactcttatggatagtcataattgaaattgagttttcacccttgaaactagatactatatctagccattcaccttgtgtttgagaatattctttgtataataacattgaaaaattcttgacaatgatatctaggtcactttttccattgtatgttgaaaagttggaaataattcttttttcatctattttttcaataatacaatcaattaaatttagcatactttcttcattgggaataaaatttgaaattaggtaagtaatatcactaactatattgtcaatctccttataggattttgctaaaattaattcatcagtaaactcatctattccattgatatttccataaaaattactaatattttcccaaattaaaggatctcgttttccttgactgcatgatattaaatctaataataggttacaagtagggtcttttaaaagctcttgatattcattttcaattcttgctttaatccctttactgtttaatgtagttatcaattttgaactataatcatcaaccttctgttttgctaggatacagatttctgatggtcgtatacctccttgaatttttgattctatatcatttgcaattaactcagcttctaaactttcattttcaaattcaaataatgttatttcaccctcttgaaattctggataattatttggctgaatagaactgtgattactatttaatatctgatgaacctctttttgaaattttacaagtttaggtacagagcggtgattcatcaacaattgatattcatttgaattaaagtctcgaatatagtctggaaaaatatcaggttttgcacctgcccatctcataatggcttgcttattatctccaactgctgttaatttacaagacgaacctaaaaaacaagtttttaataaattatactgggcatatgtagtatcctgaaattcatctagaaatacaaaatcgtatgtcatttgaagtgctttacggatgtattcgttagtagctattatttgagtactcaactttgttatttgcctatacaagaggaccggcttattatcttgtgttccttttagtaaatccttttttaatttgtgagtattcccgtcattaagtataatattttcgacaaaatttcttatatctgacatcctccatccattaacattaattccattcatagagagtagttcttttatagtatcccaatcttcaatcaaataatctcttgatggtcgtatatcctcaggtagaacatctctaaattggtctaaaattctcttttcaaaagccgaataggttaatgaggtaaaacgagaagcatattcatcaccataacgttttttaactctatctttcaaatttgcagcagcatctgttttaaaacttaaagctaaaatcttttttggagaaatacatttatttgtagaaaaaagatagtctaacttttgagccagtaattctgtttttccagcacctggtccagcaatgactagactgttagtaacatctttaactacttctaaagcagcatcctctaatttaatgactcctttaggaaaccaatcgtcactcttcaccatagtcaatatctccaagtaattcttccgcacgtctaactattttttcaaacacaggaggtaggtttctctttaattcatcatcactaattgatgataaaaattgcatatgagttgtcggctttcctctacctaaaaagaaatattgataccaaatcattagttctttttcttcatcagtaaaactatcaccgggtccactcttatcttttagagttgcttgtatagcttcactgatgcgatttttaaaaccaattaattgataatcatttgttctgtccattttagttaatcttatttttttcttgtcattattttcatcagtataagaaaccacaggtccttcattggtagataaagtccccaggtaatagtccttataatactgtaacattaggaaatcaatatcaagtggtgcagaaaagaaaacattgaatttttctaaatggtttatccaggatgacaatggttttaagaagatatcagatatctgattggaactaattctagcaatgtcttcatcattcaatattctaccatcttccattgtcactaaatcactacgctcaatacctatttctagtaactgttggatagcatattttattcttccccaaccacccccgtatctttcattatcaaaatccaataaggtaatataaggaattttgagtgaattcaataatttccaaaaatagttaacatgtctgccccctagagggacaattgaaatctgagagctatcaatctcttttccaagtaaatcaaaaaactttggtaatagcagttcctcactatcaccttcacccagtactactaacttcgcaaaatatagttcaggataggcttgaattgctcccttaatgtatttataagactcatcaatcgattgaggtaactgtatatcagaaacaatagtttgaagaacactgtcattattttcaattcttaaatacctcaaatcttctgggtcaattctttttacaatagctggagaatgtgaagttaaaattacttgagagttgtcattattgcctaattgtttaaacctttttatcagttttccaatatgatgtggagcaatatgattttccggctcctctatagctaagatagtcagtattggtggtatcagcttaaatcttggattatcaggattttcttcacggtctttagtaatttctaactcaatatcaagtatcgaatcaacaagtgaaaaataaaaaatagatctcagcccatctcctaaatctgaaactgtaaacgcttcttctgtggttgtcggtgaaaattttaaagcaatttgtctaagggctcccgccatctcagaagaattaatagtcaactctgcctgagaaaaacggttgtcttcatgatatagtttccacgatttctggatttcttggttgatttgggttaatgctccgctttcagataaaaaggtattattcaactcatcaattttgtttgtaatttcttttatctcatcgtcggtccaatttatactatttactagcctacttaacatactacctgaagcatttcccaactccttctcaggcgttcttgaagcgggtacatagagtaccctaattttatccaaatcctttctaggagcacggtgcttatcttcatctttaataatatcttcggcagatgaaatataataaatttgagtatcaatacttccttcaactgttccatcatcttcccaggaagattctaatctgattcgtagaaaagtttttgcatcaccttgagaaactgtaaagtgttcgaaaaatgatggaatggctggactgtaagcagttccatccagttcatcaaactcaaaaatagtttctataaaaagggtcctactattttcgccaggtcttaatccctttggtaaatgaaaatcacttttccgaattattctatcattttgtttatccgaaaacagcttactcaatgcttgtaatacagttgtttttcccgaactattatttccaatcagtacagtttgatcgttaaatccaataacttgactatcaccgaatgatctaaaattattaataattacttttgttaatttcatttcttctctccattagctgagactaattcccccaaccgttcctgtccggccttcaacatctcttcctcgactttactccattgcccaaagaggcattcttgtagcacttctaccgcggatccctcatcaatttcagaatcatagatacaagttctatctctttgataaatttgaatttggtcaaagagttgctctctttctaactcgcttaggttatcaaccaagttctcaacaatcccatcatggtgttcttttggtgttgctctagcctgattaggatcgatagcataaagttcttcgtaacgaatcaaggtgctgagataggacaattctggtttggtaccaatcacagctaaggaaacttggtatcctttcgaagctaataattgagcagtctgacgaggaacttgagtggtacgcaaagtcccttcaattaacaaatgataaccttgtgtactaagttcatcaaccagatgttctaccatttttcctgcaaatcccttggtatagtccacgctgtccttgccatacttttcttgcagtgctaagtaattgggatgttgagaacggtagctgtcaccatcgatgataatgatattgccttgaaattccttttgcttaatccgatgaatcgttgtcttaccggctccgctttgtcctccaagtaagatagctttcggttgttctggaattgttttgcctcggattaaagcccgaatggttcgctgtaaggccttctgaaatgcagcctcactaaattcttccaacctcattaagccaccacccgatgatgcaccatgtccaacatccgctcgataccgtctaaatagccattgtaacgctcaatttcatcgaaagtatcgacaaggtaaattttcgtattgatcaattcagccaaatcatcactcatgagaatccaagggttggattcatcatcaaaagcaatatcctgactatcttgatatcgataaagctgtgataaaatggctgctccacgttcttttatcacttctacttttaaagtcagatggtaatcttcgacaggagttaacatcttgtcctctcctacaatatcgacataagaaacgttaaatttctgacaaatacggtcgatgagttcagttgaaacagtgctggttccattttcgtagcgactcagactattgcgtgaaatcccgaccattttcgcaaattctggctgtgttaaatcgtgtgttcggcgtagtgattttatattgtctccgatcatagataaagacctcctcatatttgctttcattataccataaaaaacggataacgcaccatatttggtgcgttagccgtttttaggtttcttcgattgcttaaactgctctattcgcttctccaactgctcagtattcagtttatttttcgcttcttgaattgacttatcaagactttgttcctcatcggttataatgtccctagatatttccactctctcactagacttgaaactagaatcaaagaccacatctaggagttgctctactttggttagcttactatctgacatctctgatagtctatgaatcagtcgtttaaattgatcctgattctgggttttcttttgaaagaatttcattatcttctccttacattgtaaaaaggtagcccgcataggactacctgacttataaatcatcaatggctactgaaatagcctgcaactttttattttggactttcttttcatcaatcaattgatgaagttcttcaatttgcttctgacaggcggaaatgtccttgttattttgtgcaatggtatcagccaagtgttgtttatagtcacttgtaatatttaccttcttcggctgactttgtttaacggttgatgcgagcgtttgtacatctttagattctgactccttttgttgctgttcaaaagcagccacatagtctacttcttcaattggtttttcttcctgtttatggaagagtgctgcgattttagctcgttcttcatgggatgatgttgttttcacatcatctaatggctgatcaaaattccatgttttactcattctgtatcctcatttctgtaatctgggggcggtgtagattctttaccaaaggcttgctctagtgcttcatgaaatgacaactgacttgattgttgccgtttgataaaggtgctatacattgcagtttgtagttggtcacgatagttttctaatttctcagtctcacgtgagaccttttcttcttgcctagctactttttcagctagacgttcaatcacactcatagggcgtcctccttgtcacattctagattatgatagcggacttgattttgttatcacaattccatagcacgctctcgttttggtggaggatgattcttaatggcttgtatctgggctgactgaataagattgcttaaggatatttccttctgttgcttcacaatatcattccaatctgactttgcttcaagtccctgtaatggtggtaaatcttgaacgattggaagtcctttgtctaacaattttttacaaaattctcttcctgcctcatcgtaatcaacagccaatgttaatgcgtttgaatgggtttggaaaaagtttgtcgtctcttgtattgcctgaagataatggctaagtctgcttggttttactgtatttagaaatgccaattttccctgttcctctgctgctagacgcaagacttggtaagcaatcactgaaagttttaagccttccattgaaatcaggcgaacatctgatagctgcttgtgatgaagctgataataactcatcatatcgataactgattcacaaaaaatgagtcgcttgggattaccaatatcgaaactaataccgacatagccatgagagcctttcatgattttcttcaaataaccacgtttgtgtctttcttcatttttgacgagaccttgaaggcttgcggcctgtaagacaccattatggtcatagcttttaaacactaaaactgactccgcttgataagtagcttgagcaagcaatccttgtctaccaaaggtattgatagtctgatcacttaggccacggatgtcttttaagtaaatacgtgcttgctgaatcggttcttcatgcaaataatattgaaacggttgataagtttcttctatcaccgtagcctgttcaaaatctccagtttcaagataggatacagcctctttgaaagtaacacctgccactaattgaacaaagtcaatcacatccccttgtatatctcttgaaaaccatttgaaagtattggtatcggcaaaaatccgaaaggaatcatggtctgggtgttcataaatgtgtcctgataaacgtctgaaggaataacccaaactttcagccacatctaaaatggtcttttgttttactattttaattcgtgtcatcttgtctccctatcaaaaaagcagaagactgtctcctgctagttgttctcacttgttgtagttccttggatcgttggtatgctggaattagcaccatttgtggcttctttcatgtcctccagtttcccattccaaatggtcaactgattaaccaggagcttgtcggaaactttggagtaggataacataaccgtcttgatttctgtctgagtggttcgctgttgttgctcactcaaatcagaaacataggtcacttgataggtaacttccgcaagtgcaacattgctttctgtattgacatagatactcgctgattcaaatcggtagtcaagcatataatctttataaacttgattaattgctttattctgatttgcttcctcttctgaaaatgccgagtccgtcatgtagggcttgatacgagcgttattttcacccagctgaaccttggtgaaatattgagtgagaaattctttgacaagctcatctgataggactgtcgctctttcctcctgctttttctttgacacaagtttattggcttctgctcgtatttggttcgctgtttgctttgaaatggtttgtgagccaatcgtgtagccaatcatgaccataaaactgactgcgattaaacctcctactccaatcagaaatcgagctttcactttatttaacatggcttactcctttattagtgatagcctcatcatatcaagattaagttggaaattttatcacaagaaaaatatgattaactacaaattatactctgtaaaaatcaaaaatagcaaaccagaacctattcaatagataaagatgttgaattatagttcgttgcgttttgaagtagccagctctattccaaattctactgaactagttttcagaaattggtgctcaaatatcttttcaagaaaatatagttataatgactctttaagaacattaaaaattttcactccgattactttaaaactgagccaaataactttattttccggattaactactttgtagaataatttaaactaaatatttttaagatatactacaataaaagacatatcctataatttctgtagtaggaacaatctatacagaggctatagttttttgagtatataaaaaagttccataagacctccctaatcatcattaggaagtgcttatggaacaattttagaataccacagtactcttcgaattagaaaataagaacatcaaatcgagaccattttttcaagtcaacacgcatatcactattcagcgtgagcttgattacccagctccaaactaccttagtcagatgttattaccaacataaatctacagtatctattctgaatatcaaagggatgccaactatgttaaaaaccaaagatgtcttcttcagtgtaaatcctgtaaacagatgacagtcactgaagtgtctctcatcaaaaaacactaaatctcacaacccatctgcataaagatcactcaatactgcaccgaaaaactcaccgacacttccactacctaaagacttcctttctcaacctctgtcgtacaacggcagttagaactgctatctgacggaatttccctattctaacactaatttaaagcaatcgataagctcatcaaggatatcaaacgtcagtcactcagttttcgacaagttacaaacttcagaaacaaatttctaaactaacttaacatcaaaaagatagaatcaatctgttcctctctcctatagattataagtttcctactacagctgcaatggggctttttaacaaccaaattatgaccatctgaataatttataacttatcaaatgtagaagatagtatatctttgtatttattctacattattgctttctaaatttgaaactacatactagaaagactatgaataacaaaacatcgacaacatacagagacctactctcaagatatattcggatggcattgaatagaaaaaacattgatagagttaataacgcatacggtattacttttttcatgaatttgaacctcctttacaccagtatatctaagttacaatacaaaatcatgagtaaaaagggtaattacttaatatatcctaacttctgagcttttataacagcttttaacgttgaatcaacttcgagtttttccaatatattttgaatatgattcgttagcgttctatcagaaatgtaaagggatttagcaatgtcttttcgtttttccccatttcctaaatgtataagtatttctttttcgcgttctgtcaattcatctataaaataattctgatttggaaaataatttttcccataggaaatatctttaagaatctgaattaatcttttggaacttatatttttaggaacaaatgcctttactcctaacttctgagcttgatattcatatacaggtaaatcaaatcccgtcaataatgctatcttggaatcaggatattcctctaaaatatcttgagctattccaaagccatccgtactaaatttattgtctaagttaatgtctaatagtatcacttggtactcaattacttttgaaaaaatgcttttaaattcatcttcatcattcattatatcaatgtgaatatctggttgatactgatgtatagttaaggctaaactctctgcaaacaggctatgatcatctattaataaaattttcaattgccttctctccttccaccatcaatttgatatcgactcttaatccgttagagtccgcttgctcaaaagtaatagtcccccctactgactttacttgttcttccaagactaataatccgtgtccatgtttaaatggttttaacttttgataatagccattatccataactgataaagagagttcccgcccatctctagccaattttacagtaaccgtttgagcattggaatacttataagcgttattaacgagctctcttaaccatctatatattaaaaaatcataaggaggatagataactatgttttttgctgaataaaagtgcagagaaatatccgttttaggataacgtttttcaaatgcttttagcatcatacgatagttatcatacaaagataagccttttagcaattgaggactatactgattcattcgctcacgaacaaaagtattgagatactctagtctttcttcaataattttaactgatacgcttggattgtctaaacgagatagttgaattaaagcattgatatcttgaagaatattatcatgcaggaaattcgcaaactcttgttttaaagcttcttctttcaaaattgaattaatccctacatgttcagattgcgtacttccagttattagtctataactttctccaactaactggaaaaagtactgaaaatataaaataattgttatcgtttcaagaacaactagactagttctctttaaaattagaataaacagaacaatatataataaaatcagaaaaataagtgttaataattgttctttttgtttaaatactgcatcattatgataaaacaagatgagtattaatcctgtaattagagctaaaaaataaaataaccagaacccagaaaataaagctgatgaattaaaaaaaatgaaaccaatagaactgaaacaaatcatgaggtaaaagattaataacattagccaataaaatctattggaatcatttctataaaacgtttgcttgttcctcagaagaacaattaagagagccatcgcgaacgtaactaccaaataaagtgaaaaggcaatactagtcaatcttggaaaaagtaagcttacactcgatagaagtcctactatcatcacaaatagataaaaagaagtctgtaacttttgaaaaaacaagctgagcgatatagatattaacgaagaatagattataatgccaatcatatactgtatccatggaggaaatgcggaatctcctatgacaaataaaattgagtgacactgacaaaatctgattaaccaaataataaatttgctaatcttagacctagtagatattgctctatgcaaaataaaatccaataacaataatacatttaaagcaagtaaaaacaagatattttcgatgttatttagaaaacatttagcggacaaatagattagtcctgtaataaacaaagcataatacgctgtacttaacaaatttcttctcatgtcttactcaaatctattttttttcttacataatattataccaataaaagacaaagaaaagactagaaaaaacgctaaatagtgggttacagtaaatgatttaaaatttgctaaataacttaaataggagtaggggttaacaatccatgtgatttctcccagagggaaacgtccaacaacgactcctacaatagctgttaaaataggtaatacataattcccgcttgactgatgtatcagtagactaatattgatgagtgcaatgatacttaaaatggataacagtaaaaataagctattatcaataatcacattaagggcactttctcctctcaaggaaataaaaatcagtggaatcaaaaagtgacaaagaaataaaattggcattactatccaataaaattttactatagaccactttatctgttgactagatattccttttattgttaagttttgaaaagcagtattctcaacttcacgttgcaatgaaatgataagaaatacaggaatcatcactggtagtaaaaaattactatataaatctagacctgtcacaaataaaaccttcgctggaatttctttaatcgtatatcctgcgtagctttgaaaaatgactaaaaacatacctatccctatgaatacgggagctaaataggttctcttatactttaataattctaatttccacataattccctcctaaagatgaaactttttagaaactactaaaagaacagcaccactccatataatattctctaaagtgattactaaaattataattggattgagaatactagaagttatcagataagaaataccatttatcgggaacacataaataaatatagtattagaggaaaaaagtgtttgcaacagaataagaataataacactgcttagagcagataaactatttttttctagcaggtgagtacaaaactgaagtgtgatcgtgagtaagctgaaaaatattgctgatgataacactaagaataccgtagaccaatcaatcgttaacgataaatatgtctgtgtaactataacaaagaaaatagttgacagtaattgataaaaaacaaaagatagaatgactgtaaaatactttgaaaagataattttatttttcttccctatccccaaaagcaacaattcccaagtatggttattgtgctcgcttgaagtaacaaaaaagttagtaataccatttaccactaaactcaccaatccagaaaaacctaaaaaaattagcatagacttctgaaaaggtgtttgtgctatgtccccaacttgcacatctaatgatttaatgataaaaaccgttcctagcatttgcaaacaaaaagtaatgccaagcaataacaaggctgttggggttcctacaaacctctttatttcattttttatcaatgtgaccatacactttatctcctttcgttaagtctaagaagattctttctaggtttttatttggtgaaacctccaaaatatcgattccttcttgtacaatgaattttattaaatttggtatatcttttttgtaagaatttatttcaaaatgtgattcttttcgaataaatgagatatctcgaactttcaaaatatgttcaaaaacatctggatttgcgacttcaaaaagataagagctgtcccttttattataaagttcagagagtgttccctcaaaaataagctcaccgtcatgtattataccgaccatatctgcaatcgtttctatttcactaatatggtgacttgatataaaaatcgtttttccttcttctttagctagtctgtataagagttctctgatttcaacaattcctttcggatctaatccattcgtaggttcatctaataccaatatatctggattatttaaaaaagcaaatgctaaaccaagacgttgtttcataccaaatgagaacgaagacacaactttattgcgaacctcacttaggcccaccagattcaaaactcgatcaatttcttcttgcggttttttgagaacttcttgtataatagctaagttttcataagctgttaagtttttatagtaacttggtgtactaataaaagctcctattattgactcctgattttttaagtcgttaagacttacaccgtcaaagtatatgttaccttttgtagcaggtagtaatccagtaaggattttcatcgttgtagttttaccagctccattagcaccaataaacccataaattttccctgaaggaatcctaatagtgacatcgtttaaaatgattcgattaccatatttcttacttatatgatttaaatgtatatccattttctcccactcctaattctaattgttttgatccaggttgaattaattcattatcatgtgtaataataattttggttgattcaagagcattaatagctgccatgatagcttttgcgttttcagaatccatattacttgttggctcatctaaaataataaccttatattcttgcaaaaataatcttagcattcctattctttgacgctgaccagttgaaaaattagtaccattttccaatataaataaattttcaatatttaaagcatgaggaaatatatctgaaagatttactttatcaattgctaacatcagttcttcaatagtgtagtttggacagaataatttcaaatttgatttcagagtgcctttaaaaagaattgacggatgtgatatatagcaaatatctcttcttaaatctaggttttggtctagtaagttaactcctccaataattatatttccttcattaccttccccactaatactttgtaaacctagtaaaatttttactaaggaggttttgccggtacctgattttccagttataaaaagagtatctccttccttaagagagaacgaaagatttttgaaaagatatggtgatgcattatcgtatctatatgataacctgtcgacattaactataccgttttgaatcttcgtaaaggttttaggaatttgttcttctcctaccaagtctacaagtctttcaatatttggatacagattagccacgttaattaggctacttacaattcccatcgtgggagaatacaatatcatagccatagaactgattaaggcaatttccccacttctttcaggattcaataacactataactaggctcataatagaaattagaagagagaagaatgtcgaagtggcttgctggaatgttattgatttagcttctacaattcctctatcaatctgcgactgtacataatctgataaactacttttgattttttttagataacgatgggtaattcctgatcctattaaaaaattataagatagaataccatcattagcaacacttcgaagtatagaccgtttataactttcatttttggataatttcattaaaatagtgatgaatatacagttaatgatagcaattagtaaaagtagcaaaattaacatacaagcatagattccagtgtttaatattaagtataaacttgcaaagaaaataagcattattgagataatcatattaggtacttcaacagccaaaaatctacagatttgaggattaaccgatattcgtgacatgatatcgccactatggtatctgcttatttcagattcagttagactaaataacttctcgtaaatattaactgttgatttttcttcaagaattattgttttttgactccgaaatttttctaaaatatagttcaaaccagctgttaaccatataacacctattaaaataattacttgatttatattaacgtctcttgttgataattcatttattaatttacttattaaaacaggtatcattaataataatatattgtaacccaccaaaacagtaggatagacttttccaaatttcaaattccaaatttttgtgtttctgatcctagatactttatctcttagggatgactttcgctttgtaaaagattgatttggtcttagctccatacagtatcctgaaaagaattttataaatgtatctttgttaagagtttttcgtccataattagggtcaagtatagttacctctaactcgttgtacttttctagcactacaaaatgtgagaaatcccagtaaagtattgctggaagtagtattgatgacatccctctcatattaactatcctaaacacagtagcgtctacaccgaattgttttgcaacgttctttatatctcccatgctccatccaacagcggtatttttatatttatatagttctgataactcaacatctcttcctaaatagtccaaaatcattgctaaacagcatggtccacaatcattttgttgggattgtagcttttctcttatttttttcattggcatctcccttagaaccctagagtaataacagaccctctaagtgttttttttcgtttgagataatagagaaatcctgagattcctgtaaatagcgaaatatctttttttagaatattattgtgattggatttaaaaattaaagttttctccaatatttccagtctcttcttatgctcgttagaaagcaaattatcctgattcaatacttgcaagaaatccaatcctcctaaaaatccgtggcacaaacaatattcctcagtctcacataatttattcataagataatcaatattagataatactttatcaagatatctagagtcgttacttattttatataaaatatattcagaaacaagataacctgtcaatccgttgcaccatcccgagctaggatataataaaacattatcctgactctcaaagtactcaaatctattcataaactctgaattatctggcaaaataagagaacatattttataaataacctttataccggtaaatccatgagcaaatcccactttaaactgttcctgattttttgttaattctaggaaaatttctcctaacttcttcaattcaactacatctactaattctggctttttcaaaaatattaaatagctttgtaaaattaatccacccaaaccatcaattatatcaaattcagtaaagtctatatcatgaagtaaataatcgtctttatttaaagagttatttaaatttttataaagcaataatgaagcatagccattaattaagcctatatcttttgaatttataatttcttgttcaataacttttaaatcaaatatttcttccaattcatcataagataatagcaatcccaactttccttcatatagtcccaaattagactctccatatatgtaattaccactagaatctttctgaagagtcagtgcataaggccgtgggacattaaatattgattcccttactaattttttaacatctaattcaagatgattatttctcaatttagaaaaattgtaattatcaatattcaaacagactctaaggagatttaattgatattgtaaatcttcatcggacatacaatttaacttaaaatttacagaatcgtaaagactcataagatatttagtatccctgaataattcatagttttactaatagtctttcctaacattgatttaatagtctttaaagtattctgcttcatcacccattaggtgatgaaaaaagaacccctttctgatttagcggacaaatactttgacctaatctcagaagatataaaagaaaaaataataaaatatccgatttatactttgtataaagaactaaagtagttagcaaatcatttacagcaaatcactatgttccacataccattttacatacttaccttatccacgacacatgttgagatagtatcgaagataaagaaagttgctccatgttgtttttgcgagatggggaaatcaaagccacattgacaaccatgatgaataagcttgctttcagtcataagctaatcctagaaccacttttcaagtcagttagccaaatcgatgaagaaagcgaccgtgaaagaatggacgctattgataagctaatggagcaactattggaagaacgcaatacccttattgcactgatgtccaaaggtttcctagaacctgctctttttaatcaggaacgaaatgttttagatagtgagattaaaaatcttactaccgaaaaaacaaacctggtaacgaactctgcgagtggggttttgcgagcaaacgagataaaggacctcattaattatgtgtcagcagataattttaatggtgactacacggaagaactatttgaagaatttgtagtgaacatcattgtaaattccagggatgagctgacattcaatttgaaatgcggtctttccctgaaagaaaaggtggtgagataaatggcatatattccatatggatacaaaattcaagatggagtggttactgtcgatgaaaaggcagcaggtcaagtaaaggtattctttgagaaatacatatcaggactatcccttacagtggctggcgaacaggcaggtattgaaaagacacattctgtgatggggcgcattttgaaaaacgtcaactaccttggaaatgatacgtatccagcaattattgataaagagatatttgataaagctgaagaagttagagataaacgtgcaaaggatttaggacgagtggtagagcttgccgctttcacctctccccctcccaaagaacgattcaaaatgaaaaaggcagataataagatgccagtggatccttttgaacgagcagaatacttatacagtctgatagaaagcgaggaataaagtgacagagaaaaatataatggttattcctgctcgtaaaagagtaggaagtacagccgcaaaagaaaagataaagaaacttcgtgttgctgcctattgccgtgtttctacagaaacagaagaacaaaattctagctatgaggttcaggtctcacactatacagagtttataaagaaaaataatgaatgggagtttgctggcatctttgcagatgatggtatctctggtacgaacactaaaaagcgtgacgaatttaatcgcatgattgcagagtgtatggacggtaacatcgacatggttattacaaaatccatcagccgatttgcgcgtaacaccctagactgccttcaatacattagacagctcaaggataagaacatatcagtttattttgagaaagagaacatcaacaccacggatgccaaaggtgaggttttgctgactattatggcatctttggcacagcaggaaagccagagcctttcacaaaacgttaagcttgggctacagtaccgataccaacaaggaaaggtgcaggtcaaccataagcgatttatgggctacacgaaagatgaagatggaaatttaactattgtccccgaagaagctgagattatcaaacgcatctaccgagaataccttgagggtcagagtctagtgggcattggtcgagcccttgaaaaggatggtattttaacagcagcgggaaaaccaagatggcgaccagaatcagttaagaagatacttcaaaacgaaaaatacatcggagatgcccttctgcaaaagactgtcacagtagattttctgaccaagaaacgagtgaaaaatgaagggcatgttccccaatattatgttgaaaatagccatgaagcgattattcctaaagagttatttttgcaggcgcaagaagaaattcatcggagaagcaatatctacacaggagaaggcaagaacaaaagaatttacagtagcaagtacgctttaagtgccatcaccttctgtggagattgtggcgatatttatagacgggtctattggaatatccacggaagaaaagaatttgtctggcgatgcgtgactagaatcgagcaaggtcctgaagtttgtaagaaccgaaccgtaaaagaagatgaactttatggtgcagtaatgactgcgattaataagctacttgcaggtgggaacaatatgataaagacactggaagagaatattcatgctgtgattggcgaaaccacagaataccaaatttcagagattaacaactcactagaggaaaaacaaaaagaactaatcaagctggcgaacaagggtcaagactatgaccacttagcagatgagattgatgagctgagagacaagcgacagatccttttagtagaagatgcctccctcagtggcgagaacgagcgaatcaatgagctgattgaatttatccgcaagaacaaattccgcaccttagaatatgatgataagcttgtaaggaagataatccagagcgttacagtctatgaaggccacttcgtcatagccttcaaatctggcatcgaaatggaaatatgaaaaccagaagtaaatagcccatgactctacagtagagttgtgggttttcttttgcttgctgattataataatattttaataactattgtgtttatcaaccaaatggtttataatattcttagcgtaaacttggaggtgctgtatgactacggcagaaatgattaaagaactgtgtgagcaaatgaatataagtgtttccgaacttgctagacgtattggccagactccacagaatttcaataaaaaattacaacgagaaacagtaaccttggatgagttgaaggccattgctgatgtgctaggtgtcaagtttgtgcaggcatttattttaccagatggagaagaaataaaaatatctaacgaataaaggaggatgtttatatggtaggtaatgttattcaaatagtaacagagaaattatcatctttgccttttatagaaggcatcgtattagggggctcacgtgcaagaggcacccatacagaaaattctgatatagatatcggaatctattacaattcagactcatttgacctgacagcgattaatcaaattgctacagaattggatgataaaaatagaaacaaccttgttgtgcctcccggagcgtggggtgattggattaatggcggcggatggttatttataaatgggtatcatgttgacttgattttacgtgatataaaacgggtagaacaaataatcaaagatacggagcaaggaattgttactgccaattatcagaccgggcatccccatggttatataagtgcaatgtatcgtggagaattagcgattagtaaaatactatatgctaagaacgaaagcttatgcgaattaaaaaagcaggcagaaatttaccctactgctctaaagaaaagcttgatgaacttttttatatttgaagctgaattctctttaatgtttgtaaaagcaaatgcgggggtagaggataaatattatattgcaggccatgtttttcgtattatttcatgcttaaatcaagtactatttgcatgtaataatgcttattgcattaacgaaaagaaagctataaaactgcttgaaacttttgaatataaacctgaaaaatatgccgaaagagttaatcatatttttgaagtactcggtctttctctttttgaatgctacgatatgaccgagaaactttataaagaagtgaatgaaattgtatcggagataaataactttttaaacgaggagagttcagatgaaagaaaacaaatatgatgataatatattttttcaaaaatacagtcaaatgagtcgctcgcagaaaggactggctggtgcgggagaatgggagactttgaaaaagatgctacctgattttaagggtaagcgtgtgcttgatttaggatgcggctatggatggcactgtatatatgcgatggaaaacggtgcttcctctgtagtaggtgttgatatttctcataaaatgctcgaagtagcaaaaggaaaaacccattttccacagattgaatatgaatgctgtgccatagaagatgtggatttcccagaggagagctttgatgtaatactaagttcgcttgcgtttcattatgtagcagactatgagaatttaataaaaaagatatataggatgctgaaggctggtggcaatttagtttttacagttgaacatcctgtttttactgctcatggaacacaagactggtattataacgaaaaaggagaaatactgcatttcccggtggacaattattattatgagggcaaacggacagctatgtttttggaagaaaaggttacaaaatatcatagaacactgaccacatatctaaatacactgctttcaaatagttttataataaatcagattgtggagccacagccgccagagaacatgatggatattccggggatggcggatgaaatgcgacgcccaatgatgctgattgtatcggcaaaaaagaagatgtaataatatagaaaaaataaacgaggagtatgtaaatgagatcagaaaaagaaatgatggatttagtactttctttagcagaacaggatgaacgtattcgaattgtgacccttgaggggtcacgcgcaaatattaatatacctaaagatgaatttcaggattatgatattacatattttgtaagtgatatagaaccgtttatatctaatgatgactggcttaatcaatttgggaatataataatgatgcaaaagccggaggatatggaattattcccacctgaagaaaagggattttcctatcttatgctatttgatgattacaataaaattgatcttaccttattgcccttggaagagttagataattacctaaagggcgataaattaataaaggttctaattgataaagattgtagaattaaaagggacatagttccgactgatatagattatcatgtaagaaagccaagcgcaagggagtatgatgattgctgcaatgaattttggaatgtaacaccttatgttattaaaggattgtgccgcaaagagatactgtttgcaatcgatcatctgaaccagattctacggtttgaactacttaggatgatgtcgtggaaggttgggataaagacagaattttcattaagtgttgggaaaaattataagtatattaacaaatacattgatgaagatctatggaatagattattatctacatatcgcatggattcctatgaaaatatttggaagtcattatttatatgccaccaattgttcagggaagtgtccaaagaggtagcagaactactggggtttgattatccagagtatggtaagaacataacaagatataccgaggacatgtataaaaaatatgttgaaaatgactatttttaaagattagcaaagattattaaccataagcaaggggtgtaaatgtatggaaagtactgatgttataaatgaaattagaggtatattacctcgtaactcaattggaaaatatgatttactaactatttttacacataaaaccgtttttgataaaattgtaaaagtactatcattggattttcaaaataaagtagattatgtggctgccccagaagcaattggatggatactaggcactgccatagccaaagaacttggagtggggtttattggagtaagaaaaggtgataagctgccatacgcaaaagaagagattatttcgacacattttaccgactattcaggtcaagataaaagctttgaaatatctaagagttctattgtgaggaacaaaagagttttgattgtagatgattggatagagacaggttctcaaatgaaggctttaatagctttgttagagaaattggattgcagcattattgggttggctactattgggattgatataaatgaggttactcaaaaatggatagacagcagttttgtagcttatattggctcaaacatataataaaccgaaagaaaatcttgaatcaaaattttggatggcgttaatttacaatacaacgaaagatgtttaccctgaataattcatactttttaattgaaaccgtctgaaactgcctaacggcagtctgataattacttttttagtttcaccccttaagtgatgaaaaaagaaccccattctgctatggtaaaggtgacgaaaccaaccataagaaaggagttcttctcatgactagcttacacaaaaatcaagttaaattcaattcaaatatcactatttcacataccggtggtcgtctatcaagtgattcggggttagtcctggttaaagaattaatgaataccttcggcttttcgcacttagctaaacaatggctccatattacagatcatcgggcttattttacccatgataacttagcgatattggaacagcttattatgcaattaattgctggttactcggcagactcatcagctaatctattaagacgggatcctgtctttcaagctgtactcggtaaaaaacagttggcatcacaatcctcaatctcacggtttctggatcgtttcaccgaggagaacatcgatcaactccaagcattaaatcagtcattgattgataaagcacgtttaattcgcaatgacaccgagttaatcattgatgtcgattccacacattcggatacctttggacgccaagaacaaacagattataatgcccattatcaaacctacggctatcacccattagttgcctttgatggactgaccggagatttcttaaaagctgaactgcgttcaggcaatcagtacacatctaaaggtgtaaaagcctttatcaacccgcttttacaccactacaagagcacgttacctcataccgagatattggttcggggtgacagcggcttcgccacaccagaggtgtatgagtcttgtgaagcaactgaaagccagtacgttatccgattaaagagcaatcggaggttaagtcagttagctgaacattctgttctttacggggacaatcaagaatgggaagagcgagaagtgcagtatttttcactaccttatcaagcacaatcctggtcgaaacctcgtcgtgtctgtatacgctccgtccgtgaaggaggagaattgctatttcatcatgcgtttattgtgactaatctatccgacaatgtctcgcctgaagtcatattttctctttacggcaagcgaggaacaatggaaaatttcatcaaagaagcgaaaggtggcttttacttcgataaaacagatagcccgcgtttcttagaaaatcatgtcagaatgatgatcagtgtccttgcatacaacctcgttaattttttaaaaagcattggttttgataaagtgaaccagggcatgacgattcattccatccggctgatattgcttaaagtagccggtaaacttgttcagactgggagacaggtctatctcaaactgtcaagttatcatgtgtatcaaactgaattttataaggtttttgaacgcctgcggcgatccaaacaatggatttagactagttatcacacaaattttttaaccgattctttttcaagggattcgtctgcccttaaatagacaaataatttttattatgatcttcttccgtaggcatcctgttcgaaaacacattattttggaagaaagtatctgcctaatttaaaaattggcaatttgttcaaaaaaacaggttaaatttagagctatgaattattcagggtatcatttcttgaaacatttccaaaattaccaaatgtaaacaatgggacctcaccattaactaattgctcaacttcaagcataatgtactttttttcatgactactgattactggtatttcttttaagaagcttgttaaaacatttcttgtttttagctcatccatcaataaatctggcacagtaattcgatcaataagtgctgaatatacagatgtatttcttaagaccaatctacatagtaaggcatttttataccttaagactactgtttttataatcttataacaacttctcaatcttgaataaccaaatatgaatccagattcaatatcacctaaaaatttatttgcagaaatatgagattcatggagtaaaggtaagaattctttgatatcattaaattggtgttctgtcaattccaatcgtaattccgaactaaacgggttaatttcttcaaaaactttttttacaactatatttacttgacctatactactacagtcaaatattccatcaaaatttcgtctatatttcattgggagtaagccagttgaaaagatgctttgtgaaattcttccctctatttgtgacacaggatttattaaagtttcaaaatcaatcacatagggatgttctttacaagcaataatattttcattgtgcatatcatttccattcaacacatacgtaaatgccaaaagcactcccatatttctataaaatgaatggatttgacttttatcatggcaggacaaattgtcaatcttctcttggatcataaaattgctaccaatgaatgtatcaggaaatttgaaatacttagaatcgaatactctacaatttaattcattcaaaattggatacaaagtgtatcctgaagtcttataaaaaaatgatttattttgaagttgaaagctgatattcctattactaccgtgattgtctcccaccattgataatatttttacacttatattttcttgccttagatcaaaattttctataatttcattataattcttggttaaatttttcaaaaaacattcaatgctaatttcataattttctttcaaaagattcaatcttctttttaaaactggatatttatcaagaaagtacaaaccgttattaagaatatttttacaaaattcattgtattcactatattttgaattggttcctttccctatcctaaataaatttatttcttggaccaatacaggaagtagtatttttctaaactcttccttaaaactattaataatgctatcagaaaaggagcacacttcactaaattttgaagtggagaaagaaaattcctctattacctttgaaattactatatcaaaacttttttcctctgtaatattaattgtcatagatattacctctagtaaaataaaaggaaatgccctatcaattatggcgataggacatacatagttacaaactaatttttattttaacaatttttgcacccagagatgaatccaatatttacacaaacatttgataaaaagcctggacagtctttagttagagtcttaacaaacccacttccagcaccaccaattaataatgtaatttcttgatcagttgcagtttgaacatagatttctggtttaatattattcattataaattcctccttgaataattaattatttgtaactatgcttccctataagattattataaatcgattagtgatgtaaaacatgagtaaaaaaggcaaaactctatggtacaaatcctaaaaataacgaaacgagaaaataaacctgcaaactaaataattggttctctttattcctcttattaaattttgctttttgcttctcaagttcatctattctgaactgtactatagcttgaaatatcagttcacattggctttcttctatgtgtattgaaaaaagcaaaataatatcttaaaccaatcactaggaataccaatttacatattcctgataatcctaagatttaggttgctctatttttaagatttttatagtaattataaacaagagaaagttattaaagataatataaaaaccagtaaaactccaaataccattagttgctaaatcttctgtataaaggtagctctcagtaaagaagaggtaaattccatagatttcaataaagattattccactgatgagtccgataaggaataaagtacttgaaactttcacaatctgataaaagacaagtaacaacagtcctattgctgcgataatcaaaaggctttgtagaatttgttccaacatcttacacctctttctaggataactgcttacggtaatagctagcctgttccttgtctaaatcatcaagttgggcaaccaagtcaaagtattccgccttcgtcacctcatctaagcttggaaaatcattctcacgactcgtgatgatgagttccagctgtccagtgatttcacgctttgagaagctataatcaagcgtttcatcttcatactgttcctttaaagcttggtagttggctctatcctctgggcttgtaaagccttgtgccaaccattcttctagttgataacgcatttcttctagtgtttgggccatgatctattctccttttgtgatttcttgctttcattttaccgcgttcaaaaatatttgtcagccttttttcttatatctcgagtgctatttgttgcttcatttggggtgttgtatcttcactaaacttggccaaagccgcatctatttcctcaatttctgcttctttttcaaccaagggagccaaaacatcatacttagcctttacaagctgataatcttcttccttgggaaagactttttcaacttctactttggctacttgaagcttatcttttaaatcctttaccagcccttctgtcttttcttggtcatctattatatggtcaatggcattactaatccgttgaatggttcccacgtctgatttcaaatcaagagcgactgtgtattggttatcacctacaatcgttaaagagacggtctctggtaagggctcactaggacctcgtgtagtcattttcaaatcaaatcctctaaagttggccagagtcctgacttccttagtttctgagcgattataggtaatgagtttacgcaggtagtctcctgcttcagcacgattatccatcgcctgattgtcaaaccgcatgacaaaatctagatgtttagttgctagggattgggcaatatctttatcgtattggctcaaccgtatctccatgatagggagatgcttctcgcaataggaaatagtgtgacgatattcatcttttgaacggttaaaggctcgtttttgattttctaacaccgtcagttcattttccaattccattttcagtttgagataggggttacctgtcgctagagctttgaagtcagaagcggtcatggtttgttcatcaatgtcttctgccgaccgcacagggtcttttgaggtcataatctgagtgatatatttgagcttattctcctgtgtctgccagaggtaattatcaaaactccctttggtaatgtagtgataaatatccacctcttggtgcatattcccttgtcgaatcagtcgtccatttcgctgtacaatatcagaaggcctccagggaacatctaagtggtggacagctttcatgcgagattgcacgtttagacccgttccacctttttccgtagatgccatgagaatccgtacttccccactattgacctttcgtgatagggaatttttcttctcatcggtattggcatcatgcacaaaggcaatttcttctttgggaatccctcgatcaaccagcaaagctttcagttcattataaacatcaaaaccttcttccttacttttaggtgttccaatatcagagaaaatcatctgagtagccttttctcctgctccttcaaggtagattcgctcgacattatcaaccacttgaaggattttctgattatctgataaggtataaacagggtcaatcaaccgcatatcaatagctagttttctagcttccccggttatctttaacatattatctctacttgggtcaacactacctgacttgatagcgtctgaacgctctaccagttcttctaaatagtatttctgagcttgcgttaactcgctttccaccgcaataatcttagcttcaggaacaggtaaatcaagcatgtctgatgtctgaatatcggcagtttccttgtagattcgcatgagttcaggcaaattgacaaatttcttgaaccgtttcttaggttggtatttatcacctgtcggggctagttccatagagttttcgatattcccaaaagccccaacccatgagtcaaaattggatacctgatatcgttccaaaacatcgggctgaatgtaattcatcatggtgaaaagttcactgatggagttagaaactggtgttcctgtcgcaaaaacgacatttctatcgccatgctctgcctgaacctgtctcaccttcatctccatgtctacgttcttttttgaagtggtattggtgattcccgcgacattcccaagtccagtgattggacggatattcttgaaatgatgagcctcatccacaaaaagaaaatcaattccaaggttttcaaattcaataaaggtatctcgctctagtttttggagttcttccaactggtgctctagtcccttgattgaacgctctgcttctttgaccgtataatcagaatcacttcctagtttgatttctctgagttgctccagcttgtcattgatataggtaacctgcttctctcgactcatcggtattttttcaaactgggaatctccaatgacaatggcatcatagtcgcctgtgataatacgtgatacgaactgcttacgtttggctttgacaaagtccttcttggtggtcacataaactttcttagttgggaaaaatttcatgatttcttgaccaaactgagcagttaaactagacggcaccacataaagtggtttatgtaccattcctagttctttcaacttgaaaccagctccaagcatggtcaaggtttttccagaccctacctcatgggcgagtagagctcgtttttcttccacaatccgttgaatggcattcttttggtggggacgtaaggagatattctgggcaagtccatcaatggttaaatggctaccatcataggtctttgatactgtacgattatagagactgttataggtgtcttcaatcatctgttggacttctggatattttgctacaaaatcttgaaagagttcttgtaggtgtgtttccttggcacgcaggactgttgttttctccacatccgtcacattctttttcttatccccttcgacaatttgttttgtgatggttggttgattggaattcaggagattttcaaatattttacgaccactattataacgagaacctggtacacctaaactcctatccgttgcgttggaataggtataggcaaacttagattggtaagtgataactccgtcaatgggactgacttcaaggactgttgttacttcttggtctgacagttcataggctttccccataaaggtttcttgggcaaattttccgtaaacagacaaaggaatccagcgtgaaccgattcgataatcaatgtctgctaaagtaatgcgtgctggtttgactgtttctagaagtcctgcataatgcggccagttaaagtcctgattgtcttgtttcacgaataggtccaccacttctaacttagtgacgacatcacctgacagaaagtcttggcgagaaacataggacagttccccattcaaatacttctcaggatcaggcataatgaggtcacctaactcctcaatcaaggtcatcttcgattcaacctgatagatagacatcatataagcgaaatcaacaccacgtccgtcagccaaactggaatttaaggcatcaagggcagtatgtacctttttaacctctttttcaggacgcactagagccttttcaaaggcaagggatttagtatagataacagactttccacttggatctagactttcatcttccaaactagccagaagcgaatacttatcatcactatcaaaaagattgcggttcactgtactgtttaaatacccgtagcgtttgacaaagctatcataggtacgattgagtttgcctaacaagtggttaaaggtctccttatcatagtcataatagcgttgaatggcaataacttcttggtaggcattgcgaatatcgaccattcccttaatccgtgccacttctttctcagacaagggagtttcatagaaaactgtctttttataataacccttaaactgaccacgtttggctgcatcatcggtcacataaacatctagagcagtgctatcagtcacctctaagctaataaatctatcaatctgtttttgagaatgcttggtgtcccatgctttgaagttgccctcttcatcgacataataactgatttcttccgtcttggtccccactcgaatgcctttgttatctcgatagtaaactgtagaaccctggtaaccaaaactgtactgacccagattctccctcatttcagctggaatggaagtatccatgacttgtttggtcaatatgtctggattaatgatgatttcatttctatcaatctctcttggggcttttacttgatgtagagcagtttcaacacttgcgatgaggttgtcactagtccccttaacagaaagtgttccgccgttaaaatttctgacctcgtaggttcctagcacttggctattgtattctccatcaaagtaaggattgagccaaatgcgactatccttttcataacgaatggaacctgaaaaggctaagtcatctgtcacatatcccttgttcaagtgtttctggaagaacaacatatccgttgtaacattcgttcctgcaatggccttaaaggtagagtcaggcaatcgaacccctccaagaaattcagttgtctcacgaatatcttgtaagatgttttctgttcgcttatccatggttcctgtggaagagataatcgctacttgtccaccatcatggaccaaatcaagtgactttttgacaaagtagtcatgaatcatataaggcttatcgtacctgttatccgcaattcgtatattggcaaacggcacatttgaaatcaccaaatcaaaactattgtcgttaaaagccaccgtctcaaagcccttaatttcaatatggctattcgggtgaaggtgcttggcaatggctcctgtaatggtatctagctctacgccatatagctcactcttttctcttaagtgtttgggcatagccgcaaagaaattccctgttcccatggaaggatctaggattttgccacctgtaaagccgtctctttccaacttatcccacatctgatgaatcagggcagggtctgtgtaataggctgtcagggaggactgtttcatatccgaatactctttatcagtgactaggcttttcagttcttctcgttccatagaaaattttggattatagtcatcaaagaaatcattggcaagtccaccccagcccacatacttggcaaggagttcttgttcacttaatgaagcattgcggtgctctacttctagattttttaccaaacgaatggccgcaatgtttgtctcaaccttatctctagcagtctttggataaaagtccgtcatatcttctggaaaataaaagtccgttactggaatctctggaattgtttcgacgacttcctcttcaggaatttgattatctgattcttcaagttcagtatcgttatgacctttttctgaaccatctggttccaatagtccaatactctgaactggctcctcttccagaaatgagaataggtttaattcttggtccgcttcttctaactctgtttgtttttctgcctttagctgatgaagtgcctgcctgacttcttcccaggtcctcatataaagaactggattttgttcaatgatatccgaaaaatcattgactaactcaatccgaatcaaaccgttcaatcgagcatcgctgaccgacacgacctcaaagtcctgtcccttataggaaaccaatgaccccagaggataagtgtccaatactctctggactagtggattttccgcgaattcttcatcaactactactttcgactcagctttctctagcttgcttttccaatctctgagggttaaatctggctgattgcgtttatctttttcaaattgctccgcatcttctctgctgagttcttggtgtaaaaaggcgtaggcaacttgtcgcagctcttcaatggaaagctggctaccaaagaaaaattcaaccttttcatgactcaatcccatttggagtagttctgtcgcaagggctagttgagttaccgaggctttgggatagccacctagtaaagcaaggtccgcatttttcaaacgaaaacgacctgccgcatccaataaaataccgacttggtctgattcaaactgagatagctcaatccctagctgagtcaatttttcttgattttctatccaaatggcttgtccaattttttctaattccttttcttcgactgtggtcagcgttcgtttcagctcatagggagtgccatcagcttctagataggtaagtaactcctcgccctcaaagactggtgtcatttccgtctcagtatcaaaatcacctcgtctaaaacttgggactttggaacgttcatttcgaatttggtcaaaatatgttagaatctcaaatttacgtcgtaaagataacgcttcataagctggcagatgacttgtttttcctgtttgaacatctagttgagacaaatctacatccaaactagcaatgatgagagagccatcttctctaaatgatattgcttgatgaacactagctttgtgctcatcaccagtttcttcattttctagaactgtttcatctacttttatttcaagctcaggctcgtaagttaagagaaactgttcaatatctcgactaatccgatccgctaaattatttgccacacgataaacattgaccaaattagctcccctactcttttgtaatagagaatctggtgaaatagtttggtagtgtccatttgagtctaatagttgaaaacgagtggccagattgaacaaggccacttcaatcaccaagtctttttcagacggcgatagtttgtcgagtttttggagaccagtttggccgaaaacttgtgtataggtcaatagatcatgagcagtatcataaggactagcctggacaaaagctgaaacatctgtctcaaagtgaagtacctgaacagatcttttgattccctgcctattggtcataaactgataaacgagactatcccactcctcatcaaaatgctctgcttggtaatataaaaacgcttcaagcaaggctctatcacgaggaatggttgctctcatcatttgtagtaagacttcttgattcattattccctcccattttaaaaaggctgagagtgtttctcagccctttgtgttaatctaggaccaaggctcgttggtctctttcttgtggaataccatccattacagttgccacatagtgttgtaagaaatgacttttctggtctagtaaatctttttgcaaggcaaggcgaaccaaatctccaaaataatcctgactagaaatagccaagtcctgttgaatcatggcctgtaaggtttcaaggctaagtagtgaataatcgtcactatccaaaacctcatactgttccaaggtgtctgaaagactatttgaggacattaaatccataataaaattagagccttcacctgttcggtacaacttttccagaatgtcagtcatatctacctgtacttcatcctgataactatcaactttaactcgtagctcatcactaatcaaggataggtcatcctcatccatataatcttgataaacctgattgaggattgttctatcagaaatacttaattccaaagagagaaaggccttgataaactcttggtaatcgaccttctccatttcagacaaagcctctttcatggtgtcaaagttccaagccatcacacaactccttttgtgggactagtggtgaatttccagattgtagctcctctaaatcagcttgaccatcaccatctgtgtcaacagactgcggattggttcccaaagctagttcctgagcatctgtcaaaccatcttggtctgaatccttttcataaatagtttttggattcatctacttctcctcctttttcttcagtccataagccgtaccaagtagaataccagctccaatcaagcccaaaagggattcctgttcccctgtatttggcaaaatgcttgctggaacaggcggttcaatagtctcaattggtggttgaggtggtgtgggttgatttggacttggttcttcaggttgaggtgtatgtgttacaactgtatttgaactgatgacatagccattcactgtatgaagataggtattctccacctgaccagccgcaatccgtttcatatgcaggtaaacatctgcctgaaaggctgaatcatcagagacagtctctaagaaggatttatcaaatgaaattgacacgaggccattttctgtatccacctgttgcaaggtatatttcgtgacttccgttccttcttttaagacagaaccgtcttttagggtgacatccgtcatcagatagctgcgataaacaccattgtactcatcatgcttttcatcatagttatcttcaaaaccatattcaaataaatctgtcgtacgattgcttggaatcaaagctccaaccaaacgatagttaaaggtttgatgcaaggccacttctttcccatcaaggctgtcatctttatgagacaagtcaatcaccacatctttttgtgggtctagtttgggaacattattaaccactgtttccgtgacataggccaagccaaaatcaatctgataggctgtattttcatactgaccacctgttttggtcaactcattttttaccgtcatcggaagcgtgacaactaaggtttgaccagtcttcacataggtctcataaaaggttttgggatcatcgctactaaggacctgaatggctcctttaggtgtaaactgacgtttagccatggcatcttggacgactttcggagcttctgacaaactagcgtaggtgctgacagagataccagatacacgattgccatccttatccaaaacttgaatgccatcaggatttagggtaagggcttcttctgggtaatcgtctaccatgtaaaatcccttggcaagaacatcatccgtcacgaccatgtccttgtattgactgtaatccaagacaattttgtaataattgaccgtattcggaagaacagtctttccatcaattgaaataccttcttgattggtattagacttatgtggagttactttagggacaaaattggtcaccgtgttggtttcataggcttgcccaaagtccacctgataagccacgttttcataagacttccctgaattaagcatggtttccaaaaccgtcatcggagtgacaatggtaatattctcccccttggtcacataagattcaaaaaaggcttgtgggtcctcaggcatgaaaacttgaaaagctccttgaggctgaattttttgtttcgaaagggctgcttgtagcgttttaggagcttctgataattgagaataagccttcaccgtgattcctgaaactgttttgccatcagatgtgataaactgaatagctgtttcatccggcaataaagcttcttctggataatcatccacaaagtaaaaaccttgtgcaatctgagagttgtctgctttaatccctcggtattggtccaagtcccatgagagagtatagtgattttgagttcccactagcatgggcttcccgttgatatccactttatccttgtttaggttttgtttcttgggttctggagaaacaagggtgttggtcacttccttggtttcatagccattgccgaaatccacttggtaggccttgtttgtataggtcttcgttggaccatagagactatctttcaccgtcattttagtcaaaagagctaaagaagttcctgtttgaacatactggtcataaaagacttggttgtcatccggcaaaaagacttgaaaggcacctgtcggtgtaatcttagcacgagctaatttatcttgaaggtctttaggggcttcatttagtgaagcatatgttttaaccgttattcctgataccttctgatcctcaagggttgtaacagccgtgccattttccaccacatcaagcacttcctctgggtaatcgtccacaaagaagaagcctcgtgcaattgtctctttagcagaacgatctcccttatactggtccaaatcccaaatcaatcggtagtggttggttgtgccaagggttacgaccgtgtcattaatgaggacgccatccgcattttcattgtttttatctggtgtaatgagtgtagttgtctccccatcacctggtgtacgaaccgttacaacatttgaagtgactgtgtaagcattgtttgtgcccttgttcaaaaggagtttgtaactattggaataggttgccccatcattttgaacagaaccatagagttttggagcggtcagttgataaaccttggttaaatctttatttacctcctgcaacaagttttcctttgcagttaaggtcacaaaattcttagtctcatcaaagccaaggacatagtttccattctctttttgtgttgtttccttatcaaagaggtaaccagcaggcaagtagtcctcaaaaatgagactagtcgtttgggcacgattgggcgataaggcatcaactgttaagggataaatcaccgttgaatcttttgcgacagttttctcatgaagattagcttggtcactattgactacttctttcataatctctggagttgtcgtcaaacgataagcgtgataatgaactgtcggtacttgtggtggagtcggaagttcttttggaataggtttgacaggtaaggttactttggtcaaggacagactaggctgcaccacttcttccaaaggctttggcgtaaaggttacaggcttttctggtgtaaatgttataggagtaaagacatctggtgttaccgtaataggttctggaacgggttcaagatccaccgttacatgaggtttgggactataaggtgtcactgtacgtgcaactggtagggtatttaaggcgaaccagtatgacaagccaacattctgtggcatatcgccttgcccaaaggtgactgtgtaggtatttcctgatgtaactgttgagacaatagctcctttataagcataacgacttgatgtggtatcccattcctcaggtaaattcaaatcacttgcacggttggaacccaaagaacgcgctagaccttcattagtcacttgaacggtagaaccattaatcggaacaaatttcccagatgaatctttaacatattctaaaccaatgtcattatgattgagggaagaatgtgtgaagactcctggcttttctttggagaaggtgacttgtgaaccgtcttccaagtaatacttggcaactacacgaaactccatcctgtctgttcgccagtcaccgtttccgtcatttcgataggcaataaagccctcggttggatcatttggcacaaccaatttcacggcattggttccagctggtgatactaggttggtaatatcgtaagtcacacggctaatctttttcctatcaaatcgtgcattttgaagattttgataattaaaactaagagtctcacctgttttgaagctgtcatagacaaagaatcctgttgaatccaaaattcttgagtagccacccagcaaagcatcgccagttgaaataatctgatcaggatttcgggtattggctccatgttgtgcttgtggctcaccgttattgagattgagggcttgagcaagggcttcagaaatataaccttcttcaccttttgaaatctcggccaaatcacgttgatagcattccaattctttggcattataggcatcaatcgcttcattctcttttctgactgcggcttctttttctttattacgtttggtaatagcttcaatctcggctgcacgatctgaaactaattgttgtttctcctgattagcttgatctactgcggcttgacctgcacggttttcagcatcaacagctgcttgacccgccttattacgcctttcaatggcttcattatctgcctttgccttagcaagtccagcttcattttctttttgaatgacctgatttttcgcaacaatttcatctgccttggttttctttgttagataatccgctacagcttgttcgttagttgattgaatggtttcaacagccttgccatagtttgtatagtctagtacagctgtcccatttcctgatgaaactacttgttcatttactgtcacatcagcatctgcataccgagtttttaggtcattgactttagtatcaacccaagcatttgtctctttaccagtttggttgaccccttcgtaggcctgtgacagctccttattttcttgttcaatgcgggctttattcgattcgtatgtcgctttgtcagctttgtaggtttcagtaacttcattgatagcctcaacttggttttgggcatctacttctgcttttgaaatttgttggctggtttctgtcgcagaagttgtatttcccaaatccattgggctatcttcatctgtagaaacaccttcagccttggcctcttcaactgcttgtgttaccgtatcatgtggtacggtgacagcaatcgctccattagattgtccagttaacgccaaactttcagtttgttcagatacagggtttggctgttcttctggtaaattcgtggctggattctccgttcgttgaatggtggtgtcaactgatgatgagacttcatcagcatgtacaactgttccaccccaagcaacaacagcagtcaccatggttccaagggcaaccgagcaaagggttcggtattttttactcttacgaaagacgtgtttctcgcctttttcctgattgacaagaaagtgatgattacatgttttggtcataaagtgtccttcttttcttttttctgtagcaacaaactgtcgctctttcctcatcataaaaaagaaggcttgattttgttatcacaatcaattcagggaaaagaaaatgttgcttttacactacaaatgttataaaattgtagtgtaaaagcaacatagaaaggagtaagcatgtcaaaaaaagagattctacttgaatttatagaaaaccacaatggcattatcacctataaagattgtaaagctctaaatattccaacaatatatttgacaagactagaaaaagaaggaattctataccgcgtcgaaaaaggaattttcctaacccagaatggagactacgacgaatactacttctttcagtaccgatatccgaaagctgttttctcatatatctcagcgctttatctgcaacaatttacagatgaaattcctcaatattttgacgtaaccattcctagaggttaccgttttaatactcctccagctaatctgaacattcattccgtttctaaggaaaatagcgaactaggaattactcttgtaaaaacccctatgggaaacgaggtaagagtgtatgatttcgaacgtattatctgtgattttgtgattcatcgagaaaaaatagatactgagctttttgtcaaaacacttcaactttacggaaactatcctaaaaaaaatcttacaaaactctatgaatatgcgacaaaaatgagcaccttggccaaggtcaaacaaactctggaggtcctagtatgaataaagctaagctaacagcactctgtcataaaatatctaagaatactggattaacctttaattccgtgatgacctattactttctagaagtgattttgaaaaaattaagtcagagtacctactcaaatcactatatcttcaaaggaggattcctactgtcaaatgttattggagttgaatctcgtagcacggttgatattgattttttgttccatcaaataacactctcagaagatactgtgaagcagcaactcaaagaaattttagcagattcagaagaaggtatatcttttgtgattcaatccatcacagctattaaagaaagtgatgactatggtggctatcgagcaacaattttgtgccaacttgagaatattaaacaagttatccatttggatattgcgacaggcgatgttgtaactcctcagccgattacatacgactataaagctatttttgatgaagaaaattttccaatcattgcttatacaattgaaacaatcctagctgagaaacttcaaaccatctattcacgtaacttcttgaacagcagaagcaaagatttttacgatgtttatattctttcaaaactgaagaaagaagacattgacttcattcaattgaaaaatgcctgtcagagaacattttcatatcgcgaaacagtgctcgattttgaaaagattattgaactactcgagaggttcaaatctgaccctattcagaatcaacaatggcaaaattattcgaaaaaatatagctatacaaagggaatttcccttgcagatgttcttgaggagatgattcgtctcatagcagttctcatttctataaattttgattaaaagtgaccaaaaaataaaaaaggatatgctaacatttatacattttgttagcatatccttttttatttcgtcgtataagcaaaactcaagctactatccaccccagataattttcggaaggtgtagttgggattgccattgtaattggtttcggagataaggaatgagccatctgggtagactttttcgacaaaagccacatgtccgtattctgctggtgtgccatgtcctcctcccgcaaatgagagtatagctcctgcttgtggacttgtccctgtctccccaccgagacttgcggctgttcgtacccaatcttggccattgcccatggtactgataattggaatcttctcaccattcttacctttgagttttagacccagttggttgatacgggctgcgacgccccaagtacattggccgtaggcataccccataccgtcaccacctcctggaatagagttttcaaaaaaatctcctcgtacagcttcaagtgcttttggatcgctttgtgcagtcccaccgttgggttgactaaagcctttttcaatttggtaataccactcacttgctcgtgtctgacgctcaagtagcttatcccctgaatttccttcccagtaaatgagaaagagttgggcaagactagctggacttcctgaatttttgaagaagtcctttaaccagttggtgtaataaggactatccccatgcaacatgaaatccagttgtaaccctaagtcataccactttagattttttcctttggcatattcgagcaacaaggtatgtctgcgtgaaccatctgcagtatctgtccattgtcctaagcctaaaccacgtttgagaatattggggtagcgtccattgtatataattggaccattgagtgagagccagccctcatcatcccacgaactgtctgtcgcaccaatagggggagatagatagtcgccctctgcacgcttgggattaatagaggattctaccgaccaatttcctaaaatggctgcaatagcttgattggtcgcacctttgcttttgagatagtcataaatcgccttggctctctcgaactcgtcgccaccaaattgaccgatagttggaacaatggtggtctgaacctggattacttttggaaagtagaaagctggattgacatagaccaacttatctgtgtcatcatcaaccttttgataggtgagttttagacccgttccatccttggtctgaccaataatgtctcctgccaagactttttgatgttcactcactcggcctgaatgaatgccaaacaaggttagtttagttttattcactcccttaccagatgtcaaaacaacgttctctccatcaagagataccttgccatccatcggagccacaataacttggccttcttttgcttctaagataatatggtgatgaagcgttggtttctcatccatgacctcataaccatatcggtataacatacttaaactatcttcatcagactgtccctgaaagggattgtccaattcttgaagggcaaaataattgccttcttcggtcaattcctttagctcttcttggtcctcatcagacagcttgtaagcaggttctttatacaagtcagacatggatttaatagagtcaccaccgtttaagtccgtccagacttgactgagaaatgctttataagtcgcaccacctgtttccatgaaatcgtcaagcttgtagtcttggtattgatgattcatgtaaaccatgacctcatcaattttggtgtagtaggcaatccctttttcattggttctcgtatgctccgcatcttcccacgtcatgtaggtataggccttggacaactccatctcatcttgttgaatgacactactacctgaaacactcatgaaaaagctcatcatcaaaaggagtatcaagagaatgcctgagacaatccaagtcaaaggatttcccgcaatgacagaaaagaaagtcatacttcccttaatggcttggacgattcctttgaaacctgcgacactttgttttctgacatgctttaaaaaggtttggtaacgtcttcttggtttaagaggtttctggcgtgtgaatctttttccctttttgaagttttggaatcgttcctttccatgagaaaattttgttttggtaaaccgcacaccagtctgtccactttttactgccaccttacctgcttgaaaggtaaacattccatagcgtctggctttcaaactagtatccttcatggttcttagaccatctaaatcatcctcctgtgctaccaggtcaagcgattcggatgcagctaagcctaatccaactttgaatttggtagagtttttcttagtcttttggactttcttgagttgtttaacctcacgcttggcagaacttacgtctttttctgcaattagtcgatcaaatgatttttcttggtgaaactgaaagcgagactccagggaaggattttctttttggaaagtaaacttgcgattaactacctgttgtttctcacttagtttcacttctgacagatgttttcttgctgtccgcaaacgttcttgagcttgcggaagtcgatagttcttgatttcctttaccttcaacagtctaggagaaacataggtaatttcctttatgaacttctcttctgcttccttttggctactgagtagatttccttttaactctgttttcttttcctgaaacagagaatttttggctgattttcgaaatcttccttttttaggaacagtctgttttgaggtcctaacttctttacgataatgcatacgagctgattttaagttgcttcgaaagttttgcctagcctgtttgactagctttttatcctctttcatctcatgtcctcattttttcagggtccgtactcatgatgtcaaagagcttggtgtgttgtggaatcttatttttgaatgggacaacggtggaaccggccttgataagtccagcccctttttcaggattgaccaagtatttctccaattccttggaaagtccaagcatatgcaccaactcttcgcgatcgctcttggcctgttttaaaagaatcataaactcgctattggcaataatgcgtctaccattggcatccaaaagaagtgtttctacattctgggtaatgcctgtcggtatcgccccatacttacggacacgactccagagtttaaagaaaaaatcagaggcatacttgtccaataaaagtagctgcatttcatcaaagtaaatccaggttttcttccctagtttttggttttttaccacacgattccaaatctggtcaaagataaccatgagggcaatctgttttaattcatcgcctaactttttgacattgtaaatcaggaaatgactgtctgttttaatattggtccgatgtgaaaatatgtccagcgacccttccacatagagttccatatcgagtgccaagtccttagcttcctgttcaggttgttgagctaagacaaagacccattcgaccaaggatggtgtgtcaaaatgcttataagtgagtcgtgtcacacggtcaatcaaggacttttcacgaccatccattttgcggtctaagagctttcctatccaagacaagagaaattcggatttgaccttaactggatcctcatccatattctcatcagatagatctaagacatttaagaaggtggtagaatctggggcaatatcaatactctccccaccaaaggcttgaccgataatactgtactcgttttctgggtcaacaataataatttcagtatcactatctgcttccttgagctttgtagagatgatttcatgttttgtcgccatccctttgcccgctccagaagtccctaaaatcaaacctgacggagtatttaacttgccacggtcaatactgatgatattacttgagatttgattgataccataaaatttcccacccttgtcctgaatatctacggaagtccaaggggcattcacggcaatgtttgaagtcaatagagaccgagaaacaccttcgagatagttcttcccaaatggcaagagactattaaaagcagcttcttgcatataggtcaaattatcaataatcatatcattagaccctgccacttgcttgataatatcaagagattgtttgagttggtcttcagtatccgcaagcacgccaattagaaatacggtgtcaaacagtttatctcctgtctgggtcatggtttgaagaagagcttctgcttcattgatgttgttctcaagaacatggccgaccttctccaaatagattccagtccgagccatcttttgttgttccccaatcttttgcgattccatcaaggtcttcttggttcgtagcttggtcatggtttcagacttggtagagcctttagcatgtaggctaatcatcacttccaaatctgactgcatgaggtcacgaataaatttatcccctagctccataccgtaatcacgaacatagacaatctgtaataatcgatcgtccaattcaatatgattcttgtgtttaaaggaaaggtaggttggggcaataaagtgtttggtagtttgacctgagagggtcaaatccttgtaagagaacggtaaatgattttcacctcgcaacatatccgcaaggacattcactcgctcctctccaccaagtaaaccaagagccacatcaatctctgaaaagccactcttgaaatattccccaatctgtgacagagaacgaaaagctacttttggtgtttggtcgctcttgccaaatgaaagaaacttgacggctgaaaagttgttctcacccgcctctaagttggcatccatcatgcgattcaattcatcacgataagcatcaaacccatcttcctgcaagggatagagaatactcttacggaatttttccaaattaactttttgattgaaaatggtcagttggaaattggtctgatcatccagtgaattgattaaatcggaatatttctccacgatagctcccttatcatctaagccaactgtttgataattgacatctcctaagagataggtttgtgagaaataacttggactgatctgcataaggccattctgaaaaagcccttgataggctaacgtatttacggtagaaggtctgatctcctgcttctgtgttttcgtcttttgctttttgtcattagaagaggtctttggtttcattgagtgttttaattttttcacgttggtctccttttcttccagtaaatgtgcggtctggcaccgttagttcataatgaaaacggtacttgaggtagatttcaaatggtaaatcattagggcgatagaccccaaataacatgagtggaatggtaaagctaaaaacaaaaccatagacaaaccaatccccaaattgccagtaaaataggttcaagcccaataccaaaatggttatggcgacggctggaaatacaaaaataacctgtctagttgtaaatcccagccatgccctgtgttgaacctttgagatgtccttaaagacacgtgtgttcataaatgttctccaatctaaataagctataaaaagaggaggcgggcaatttactcccatcctcctacatccccaaaatacttcgggcggttcgttgactgccaactaaggcaatgattaacaatatggcctgtaccaagccaccaaacataatggcgagtgattccatcactccagctccatttgatacggcaatctttccagccgattcaaacaagggaacaagagatacaattagaaaaatcaaaataccctgaacggcatagaccataatgtttttaaggtaaccaatcccaacacttctccagtcatcactaaggaaggtcggaatggtaacaggggcaaaaggaatcatcagatagagttggataaagcgaatggtaatcaagatattgacaaccatgatactggccattcgtaccaaccaaatgagaatcgcaaaaaagccaataatcatttttcctacaatcccagatcccttaatgcctgagatggtatcgtaattagtaccaccattcgtgacaagacctgccacttgttcaataacataagaggcaagggcaataatggcttccacaataaccgtcgtattggtaatcacgaccgcgaccatgatgtagctgacaatcataggtgccatggcttcgaaggtcattgcaccacctgagtttgcgattttcttggccatttttgaaaattcgagtacgagaacaaccgcaagaatagctactcccaagggctgcataattcccttggtaatggctgtcatgtaagaccaaaccgtcggattaaagtccgctagtgacttaaccaagttggcggtcgattctaaatccacttgaaacccttcaaaaaggctatcgctagatactttttcagaggctaaatatacaaaaggtgacgtaaaattcatcatcatgtcatgtgcagtcctcccctaaatggtaatctgagtcacaaaagcaccagcggctcccaccatgaccccaccaacaatttctagaatagcatttcggacacctggtccaccatctttaatattggttgaaaggttgataatgcccatgacaacaagaaaggctcctactgcaattaagcctttttgtaatagagacattgcttgggagaacatggagctggcgtccactccgtaaacaaagcctgttagtttttgattcatataattcctcatttctattaatgtagtgtcgtttctgtgcttaaatctcttattttatggcctgacaaatctacctcttcctcagcggttaggggattgatatgatagtgccaccagcgttcatcggtttccttatccgcaagccatttccaattcttatgtttgagcggaaaatatttcttggttcgaaaaacaggaacccctgcaatgcgtacaagacactcatctcgtttcatattcccgacttcatcagccgtcatcaagtcacgggcaattttctggtgagaggtagaacttgagccagtctgcccaaaagaacgactggtacttctgacatcaatggtttgtttgcctaatagaccactcataaatttgaatgtttcctcgtcatttccacccaaatagaggaggctgtcacagttccccagtatagttttccaagcctctttttccttataaagtccttggagttgagcaatattttgcaagattggaactagactcatgtttctagagcgaactgttgaggtttgttcggcaaagtctgggatttctccgacattcgcaaactcatccagatagcttctaacatgaatcggcagttgccctttaaagtcaacatcagcctgtctggtcaaagtggagaaaactgtagaaaaaaataaagcagataggaaacgaaaggtcgtatcattgtctggaataacaagatagaccatggtcttttgagtgccccacgttttcaaatccatagtgtctctttgcgtcaaatcaatcactgattggatattaaagagtgcaaacttagcggtcgtcacagcaatgaccgaatccaaggtcttgtccttgtagttctgaaaatccgcccagtttctcatggtaaagttctcatgaccatatttcttagcatagtcttcaaacaggacttcaagaacacttttgtcctgattgtctccctttgataagagtttgatgagtttcccaatctcagaaaaggctggataacggccacgcttacgtcttgcttcctgctcttgcttggaacttcctggaggattgtaaaaatccaccaaataagaggcaatagctctcaccaatgtcatggaagcctcgtcccaaaatggatcactgcgagaaccagacccacgggtattgttaaaatagaccgttaacatgcggttcaaatcattctctgtttctacataacgaaagggattaaaaccgtctgaattggtcatattaaccaagtctaaaaccttgacctgataaccgttttctaaaaagagtttacctgtcttctcagccaaatggtctttaggatctacgacaatattggaacaattaagttggataagattgggtttaacaaatcgaaaggtcttgcctgccccagaacccccaataacaatcaagtttttatttcggtcaaacaggggcttcttcttttccaacaaggttagacgaacatcacgagccaaaatcgtgtcattgaaaggattcttactgtaaaagttccgcttttccttactggttccaaatcgtgcagaaccgtattcttccccttctcgatagaccttctgtcctgtcgatacataaagatagactagtgtcatcgttagaaccccaaggataaaggcaagaagagatttttgagtaaaagcaaaaagccataaaggattgaaaacctgatttaacccctctcctaagaggtaggcaaatcgttccataggtggggcattggttaaactatcatagagtagagttagacgatggcagaaatagccaaaggcgagacccaagagaccaaagacaaatgcttttcgtcttgaatacattacaaggtcacctccttggttttgactgccgaaggttctgtcactcttattctttctttggccagttctatctcttggtccaaggttttatcaaaagttaaaccttctagtttctctggattagacatcagtttcttcaacaattcatccaagtaatgatcgagcaaggtcttatccttggcataaaagtagagatagtctttttgccaactaattgcgattggcagtttttctgactccatcaactccttaaatttctccacatcgattggcttatccagtatgtctttactaacatctatcgcttcaattgcataagggctttgaaggagttcttccagtttttgaaccccaatcttataagctgaatcttgagctaaggcttgcctagccgaccattctaagagctttaagagggttctgactgtcaataaactacttctttccacgtattgcatcgcttgacgttcttgttgttcagatgacatggtgacctcctctttttttcgattccctctcaaacataaggtgtttccataatacggaaacactcttgattttggtatcacaagaaagttacgacataagccaaactattccaaagtaaatgtaagatgattgccgtcatacaatcagttttcaatcgaacagcagccaaggtcaagccaagacagctatacatgagccaactccctaactgattggggccatgggatagaacaaagagaaaactggtcacgcctatttgtacaaaagggaatgtcaatttttcccacagcaattgcctataaacaatctcttcaaggagacttgcattgaccagaaacaataaaaagataacatgtggaacttgttttcctacttgtaacaagaccgcttgattcctagtctgaactgaaaatagaaagctgatgaagactgcaaaagcaaccatagacacaaaaccaagaagcaaccatcttaggcgatttcttaaggttatattttttgcttgaacagttttatgacgggcaatctctaagcaagtcacacttaataggaccaattgtagcaagactaagaccttaatcgtcacatagtcttgtaggtataaactcaccagaagaccgttaagctgtatggctagataaaacaacactatccttatcattatcacctcttgaataaatcttcataatcaatatctaagactagaacgattcgctcaacccatcttgtctggggcatcagacgattggatttgtaatgtcgcagtttttgatagagacgattaaactcacttggataaacatattgaccgttgaatactttgcgagctagttctgcccaagtgaggtctttttctgccagaataatctctaaattgtcccaaaatcgttcattcatcttcacacctaccctgtcacctgtttcatcagactggcctgaaacagctcttcttttacttgtctgggaagaaaagtacgcacttcgtctaatccaatagctggatagacgtgattctgacagacaatgagaggcagacgaaggttttggtctggcttttggagaatgagctgaatcatctcattcaaacttatcgaatattgacgtttaaagcgaagaaatcgtggcgacagcaactcaaaacaatccgtggttttggcaaagagtgacagtaagatttcacggtttacatcacacgcttttgtacaacgataagtcaccccatagttggtcaaaatggttagtaagtcttgatttgtattgacattatttcctagatatacctcaagcataggcacctccttatagggttaggctattttcaactgttggttcaggagttgagaaatagcgactcatatcaatgggcatccgtccttcaccaaagcacttgaccgtcactaaagtcgttaaaatgccatcctttcctctagcagaataattttcaccaaaggcacgaaaggccaggtgattgtctttcgtcaagagagtatctacaccatttttaatatccctagtttccataaaatccgaaatccgatgaagattggattcgtagaataggggatcattcatctctttgtggtaatcatcttcaaaagtcacctcaaagtcacaatcaaaattggggagcgacagtatcttttgtaataactgattggtttcaacttggtgaatatgttcttctaattcagtacaatctaggatacttttcttatgtagtaggttcatgtttttcttcctcttccgttcttctaaattcactggcaatggcttcaataactgtgacagtcacgctattgccggcctgtttgtatagttggctcttactggaaacactttctgctttgtcaaaagcccaatcaggaaagccttgaagtctgaaacactctcttggtgtcagtcgtcttattctcaggcgataaagtttcccctctaagacaatgcctgtgacttcataccacttatcctgtcgatattccagagcagcaaccaccactcccatattgtctgaagtcgtcagagtattggatattccctttcccacacgtcccctacgtttggttgagtctggataagccagattgacagagtctccaagagttgcctttgcgtagcctgtttttgtggcttccttgattttcagaaatggcagttcctccctcagtaaaatctttggcaccttgtctccaccttgcatggtggtcaaagtcggtgacaagccagatatgtcaaatactcttccagtctggtcaaagctagtcggcagatttcctgcgacaacaaccccgtgtctgtcttgactagtcaaagtaaacatagggtcttgattgtccttaagtcgacgaccatgttgccgtttttctagtctatctggtgttaagactggaatggcgattttagctccctctcctttacctcttgtaagtgtaggagcaagtccattcgtcagatagacttcaccattcaaaccacgtttagagggattgatatttcctaacctttcaagatgagctgggctgttttctcttctgagaggaaataagaatctgggacggtatcttctagaatgtccgataataaagacccgctctctgttttgcgggacttggaagtccttactgttaagcacctgccattcgacatcataccccaattcatccaacgtggagaggattgtggcgaacgtccgtccctcgtcgtgattgagtaggcctttgacgttttccaaaaatagaaaacgtggttggatttgtttggccgctcgagcaatctcaaaaaagagagtccctcgagtatcttcaaatcccaatcgtctgcctgcgagtgaaaatgcttggcaaggaaatcccccgcagatgatgtccacttgccctctaaattgtctaaagtcatggtctgtgacctctttaatgtcatggtattctatttccccttctgtgttaaacatggctttataagatgttctggcgaatttatcaatttcacagaagcccaggcatttatgaccctgtgattccatccctagcctaaaaccgcctatcccagcaaataaatctaaaaatttcatctttcctctctttccaactaaaaaagagccttacacttgtaaaactcttgcttatatatgatcatccatttctggtgcacggatgatttcaaaaatcaaaatgacgatagaaatcagatagattccacctagtatccaccaaatcaacttaatcacctccctttacttcttgtcgtctcagttgcttggtccactctgatagcacaccattaaatacgtattcagctattacttccgctgaccgagcaaatcgcatatgttccaatgcatactgataacggtcactaaaatagagcatggcatagtcactagccgactgagataaacttgtctgtcttaactggtcatgaaccaaaccccaaatatagtctcgatcatacttggtcactccatcaacttttgaagtaaagttctcttcttgtttctcatctactagctgcctctcctcctcgtcctcaataaggaaatcactcccttcagtttcactatattcagtttcacttccttcagtctcactaggggctgaatataagaccggccccgtctttctttgagacccccctagtgtttttttaacactagccccgtctgtatgtaagactggggtagtttcatgttctaattcccccaagtaaattttatttgccattcgacctctttcactagaggactgttggacttcatcgattaagccatattcgcgtaatattttcttgatagagagtagttttgactttgaacagcctaaaagtgccatcagatttgaattggaataaatcaaataaatagccccatcctcatcaatccaacctttactcaaagacaactccaaccgatcttttaaaaccgcgtaggctaccttaacctccagcttcatatccttataacgttcactctcaaacaaaattttagggagtttataataacgctctgatgtttgatattgattagcggtaatacgtttcatgattgtccctccaagactaatattccaacatttccaaattcatcaaatcggattaaacctagttgttccatttcatcaattagctgtgttgctttctcaatatcaactcctaaaatagccacgagatgacacatcacgatttggcgtgatgattgttccttcttttgcataattacctccaaaacgcaaaaaaaggggcagacaatttaatgtctaccccgaaaatttattaaaacaaaaatcctgccaaagaatttttggcaggatttttggcaggaaaccaaatcaatttatcagtttctatcaatcgcttatcgctctcaaagactggtaaatagggattccgcaatctaattatgatgtgactcttatttaagagtaactgaagcgcctgcttcttccaatttagctttgatttcttcagcttctgcagttgcaacgccttctttaaccatagctggtgcaccgtcaacaagctctttagcttctttaagaccaagaccagtgatttcacgtacaactttgataacgccaacttttttgtcgccagcagatgtcaattcaacgtcgaatgaatctttagcttcttcagcagcaccaccagctgcagcaacagctacaggagcagccgcagttacaccaaattcttcttcgatagctttaacaaggtcgttaagctcaaggatagtagcttctttaatttcagcaataatgttttcaatgttcaatgccattgtgattttcctccaatttaggtttttaaatagtttgtagcactaagcagctacgctctgacgcattaagcagcgtcttctttttctgcaacagctttgacagcgtatgcaacgttgcgaactggcgcttgaagtacagaaagcaacatagaaagcatgccttctcggtttggcaatgtagcaagtgcttcgatttcttctttagaagaaactttaccttctacagcaccacctttgatttcaagagcatcagcagttttcgcgaaatcgtaaattgttttagctggagcaactgcatcgtttgagaatgcaactgcagatggacctacaaacaattctgcaagaccttcaagaccagcttgctcagcagcacgacgcaagattgagtttttgataactttgtactcaacttctgcaccacgcaagttacgacgaagaactgtatcttgttctactgtcaaaccacgagcgtctacaacaacgatagatgttgcagctttcatttgctcagcaacggcatttactaattccgcttttttagcgataatagcttcactcatttttttacctccgtttttattttgggctaggcacaaaaaaatcgcacctaaacctagacacgaaagtacaaatacgtttatctcaataatcgttttgtgcctcggtaggatgtttatgagtccagctcccctactgtcttaggtcagttttttcaaacctcaattatcataacacagtattttcaataatgcaagacttttctcctatttttttaattttttaaacaatttttcaaactggtattgccgtttagttcgttttagttgtagaggtcagacttggaatgtgaaacacgaattgctgtgatttgcttcgcaaatcttatctccaacctttttacctcgattttttcatttctaagctcaggctgaaacagttcactgaacagtttcactccactggcctgttaaacccaatcaaccactgcactgagaagtgactttggactttttgaccagcctcatttaaagttgaaaataaggaaacgaagtttcctcgcttgtcgaagtaagctaagataaactaacatgactataaaaaacaactgccattcccttgagaatagcagtttaatcttatttaatcttgtcttcttcgtagtcaccatttggacagacaacttgtttaccaccaccacgaacttttttctcgacaagatagtggtcacattttggacaggcacgaccaacaggtttatcccatgaggtaaattcacactctggataacggtcacaaccatagaaaagtcgattgcgtttgctctttcgttcaatgacctggccttgttgacacacggggcaagttacgccgatctccttggtaatttgcttggtattgcggcaatcggggaaattactacaagcatagaattttccaaaacgacctagtttaatgaccatttcatgtccacaaacatcacagtcaaagccagctggttcatccttaatttggattttttccatctgttcttctgccttaaataattctaccttgaatggctgatagaaaccatcaatgaccttctgccactgctctttcccgatttctacatcatccaatttttgttccatatcggctgtaaatttgacattgacaatatctgggaagaattcaacaatcagcttattaacgatttcgccgagttcagtcggttcaaatcgcttagcagctaacttaacatagtagcgtttctgaatggtttcaatggttggtgcataggttgacggacgaccaacaccattttcttccaaagtcttaatcaaagtagcttcagaatagcgagctggtggctgcgtaaaatgttgttcaggatttgttgatgtacgtacaactgtatcaccttgctccatatctggcaacatcttattcttgtcagaatcattatagactgccatgtaaccatcaaatttaacttggctaccattggcagcaaaaatcactccattttgacctagacgaacactcatggtatcaaagaccgctgcagccatctgacttgcgacaaaacgattccaaatcagtgtatatagtcgcaactggtccttgtccagatattttgcaattgattcaggtgttaagttaacatttgatggacgaatggcttcgtgggcatcttgtgcaccactggcattttttactttattaccatgctttgaataggtagcaccaaaacgctccgtgataaagtcagcagcttgtgcttgtgcaacagggctaatacgtgttgaatccgtacgcatataggtaatcaaaccttgggtaccacctgtgccaagactgacaccctcataaagttgttgggcaaccatcatggttttacgagtacggaaattgattttattagccgcatccatctgcatagtagaagttgtgtaaggcagaggtgcatttcgtttgcgttccttacgctcaacctgttctactaagaaatcatccccatcaagtcgggcgagaatttctttaacctgctcattgttttcaattttagttttctttccatctataccgtagaaagaagcctggaatttcttgctcccctttttgaaggttgcatcaattgtccaatattcttctggtttgaaattgctgatttcattttcacggtcgattattaatttgagagcaaccgattgaacacgtcctgctgacagaccttttttgactttcttccataaaataggtgatatggagtaccctacaatacggtctaagacgcgacgagcttgctgggcatctaccaagtcatgattgatagcgcgcggctcctgaaaagcattttttactgcatcttttgtaatttcattaaagacaacacggtttttatcgtttgcgtccaatcccaaaatgtgagccaaatgccaagaaattgcttctccttcgcggtccgggtcactcgcgagaaagacttgcttagcattttttgcttcttttttcaaagaattgatgagtggtccttttccacgtatgttgatgtactcaggtgcatagttgttatcaaagtcaatagacatactagatttcttcaaatctcgaatatgcccgactgaagcaacgaccttataatttttaccaagatatttttcgattgtttttgccttagcaggtgactctacaataacgagatttttcttggttgttgtttttttcttactaactgtttttgtagccattcttataccttacaaatatttttaacctcacaaagaatatactatttttcagtcagtgtcaagatatttattttcctataggaagacttgttttaaaattgatactcagaaatgatgtccaatcctgatgtaacgcactttgctccctcttgaatcaaatgatgacaaccatctgattttccgtccataatggaacctggaatagcatagacttctcttccttcttccaaggcacgttcacaagtaatcaagctgccagaccgcatttttgcctcgcagactaccaatccttccaccaaaccagctataatgcgattgcgttctggaaaatggtatttgagtggctgagcaccagcttcatactctgtcagcaccaaatggtgttttccaatataggtctgcaaatctttattttcttttggataaatattatctaaacctgttccgattacagcaatggtttggcctccatttttcaaactggcgatgtgggcagctgtatcaattcctcttgccaaaccactaacaatgacaaaacgattgctcaattccttgataattttctgaacagattggataccatttttactggcatttcgtgtaccaacaactgccagctttaatttttctagcaattctaaatccccttgataaaacaaaagtacaggtggattgtaaatctgtttgagcgccaaaggatagatgtcatctaaaattgaaaatgatggatacttattaaattcctcgcgacaggcttttgtatctagattcttataattttccataaatagcactggatttttacattcagacactacagcgacatttcgcaaggtcaattttttaccgtgtttttcttgataggccaaaactttattcacattaagattggtcaaacctgcttttttccatttaaacaattcaaaattattcattttcttcacctcatctagtctattcgcaaggcaaagaaaaaattctcccgaagaagaattattttttaggtatttctttgataacacgcgcaggattgccagccaaaacgacattatcaccaaaagacttggtcacaacggaaccagcaccaccaacaacattgttgcccaaggtcacgccaggtaagattgtcacaccaccaccagcccagaaattatcaccaatggtaataggagagccatattccaaaccagaatttcgttcatcaggatctagtggatgaagtggagttagcaactgtacattgggaccaagcatggcatttttgccaatggtaatgggacagacatccaacatggtacagttgaaattagcgtaaaaatcctcaccaacatgaatattgctatcgtagtcacagtagaaattgggctccatatagatgcgttggcctgtagttccaaaccagcttttcaatcgctcagagcgggcttttccatctagttcttcgttaaattttttcatctgttggcgggcaaaggttcgcatctttctcaattcagcatctgctgccatataaaattgcccagctatcatcttttctttttctgtcgacatacccctactcctatttttttatgattaaattgatagcttgagcaagacgagcttcttgttcttcagggttttcagatggatgagtgatacaatcttgtaccttctgagcaataaccattcccatcatactattaatgctggaacgaacagcactcaactgagttacaatatcaatacattcctgatcttcttcaatcattttctgaatgcctctgagctgaccttcggcccgtttcaaacggtttatcatctttttcttatcagtattcataccctatatggtactgcttgaagtgaaaaatgtcaattttttaccttgacatctttcgaattccttgatatattttagataccctgtagggtataaaggagtaacaatgtttaaacaattattttcaggaatgttttcaaactcagatagtcttccgataactgatgtagaacaagcgatacaatcatcgaatgctattttgcttgatgttcgcgaagtcgacgaatttgctagtggacatattccacaagctatcaaccagcccttaagtcaacttgaccaatttaaaggcgacaaaaccaagaactatcttgtcatctgtcaatctggcatgcgtagccaacgggcgacagaatatcttaaatctcaaggctatcaagcaatcaacgttaaaggcggtatgaatgcctggacaggaggaatagcatgaaaataattattgtaggtggtgtcgctggcggtatgtcagcagctactcgtctccgtcgtttgatggaaaatgctgaaatcatcgtttttgagaaaggaccttatgtttcctttgccaactgcggtttaccttattacatttctggagaaatagcagagcatgacagtttattgcttcaaacgccagaaagtttgaaacaacgctttaatctagatgtccgccccttccatgaagtcattagtatcgatgctgagcagcaaactgtaacagtcaaaacgcctactggtgagttgattgaaagctacgacaaactaatcttatcacccggcgccaagcctgtcattccaaatctatctggtattgaagaagcaaacaatctctttactcttcggaacgtacctgatttggacaagattatgattaaactagaccagatcaagtctggtcatgttgtggtaattggtgcaggttttatcggtctggaaatggcggaaaacttagctttaaaaggctggaaggtcatgcttgtcgaacaagctccccatgttttacctacttttgacttagaaatggcacgatatgtggaagcagagctaaccaataaaggtgtcgaggttatcactgggcagtctgttactgcttttcatgaaaaaggacaggttctagaattgtctaacggacaaaccttgtcatctgatgtgaccattctctcagtcggagttgctcccgacagtcaactagccaaagatgctggagttgagttaggtctccgtggtggtattctcgtagaccaaaactaccaaactagtcagaagaatatttatgctgttggtgatgctattgttgttaaacaagaaattacaggtcaagatgccttgatttcactggcttctcctgctaaccgtcagggaagacaggtagctgatgtcattgctggacttgatagaaaaaacaaaggatctattggaacagctatcgtaaaagtctttgacctagctctagctgccgcttcaactggtttaagcgaacgtgctgttcaatcactcggctataaacatgccgtcgttcatacaactggaaaagaccatgcaggttattatcctggtgcgactgatattgttttaaaactcattttctcaccgactgatggaaaaattttcggagcgcaagccgtcggtcaaaaaggtattgataagcggattgatgtccttgccactgctatcaaggctggactgacaatttttgatttaccagagctagaattgacttacgctccgccatttggctctgccaaagaccctgtcaatatgattggctacgctgctatgaacatcgcagaagggattagccaaaacatccagtggtatcaactagacgacgagttagctactggtaaagttctattagatgtccgcaatcctggtgaggtcgcaaatgggcaattcagagaattcattcacattcctttggaccaactccgtgagcgaattggagaactggatgcttcaaaagaatacattgtcagctgccatagtggactgcgttcttatattgccgaacgtatcttaaaagaaaatggttttatagttaaaaacctagatggagcctattcactttataagatgacattgcctaaaaatattatccaaccataagcaactaaccttctgtgattttgggtccagaaggttttttcttgacattaaatattgtatatcgtacaatctagttatcattactagataaaagagagtagataatcatgaaacagaccattccctactggcatgaattacctgatttagatttgtatttggaccaagttctgctgtatgttaatcaagtagtcaattctcaggaaagccttgaacagaagagtttatactcaatgaaaatcaacagtagcctaggaaacgaagctgatgatagaactggggttcatcaaggcaagttgataacggataatgttgattttcgaagagtattgactgctgctatgattaacaattatgtcaagcacaagcaacttgaaaaaccggtaaagaaaaaataccagaaacagcaagttgcccgcttgattgccttgactatcttaaaaaatgtcttttcgattcaagaaatcagtcagaccttaaatcttcttctccaatcgagtcattcagaaacactctacaatcattttgttgactgcatgcgaaacgaggaaaatgaagaaacccctgacatcattcgctacgcttgtcaatctgtcaaactttactacaaaacccgtcaactcactatggagttagaaaggagtcaccatgaatcctagtttgaaattgagcctgcaactatcctttggagaggaggttgctaacagtgtcacacatgcagtcggagccctgcttatgttggtcttgctccccgttactgctattcattcctatcaagattataacctgaccgctgtgattggtatgtccatctttgtcatcagcctatttctcatgttcctatcctcttccatctaccactccatgccctatgcttctactcacaaatacatcctgaggattattgaccatagcatgatttacattgccatcgctggaagctacacacctgttgccctttccttggtcggtggttggctaggttatctgattgtaggtttacaatggggattaactatttttggtattctctacaaaatatttgccaaaaaaatcaatgaaaaattcagccttttcctctatctctttatgggctggttggtggtctttatcctgccagccattctgcaaaagactggaatggcatttggcattctcatgctggctggtggattatcttatactattggagccctcttctatgccaagaaaaagccctacttccacatgatttggcatctctttatcctactggcttcggcacttcagtatatcgccattgtctactttatgttataagaaaacagcttctagtcacctagaggctgtttttaatgcattaaactgatgatcactccaatcaagtaaagggctgacacgatgctcaaaaagaccaaatgcgcctttcggctcatgactacatagcctacaaattcccgaatgaaggcattaaggctaaagtaaaatttggtttttgcgccgtagccgatacatttgattctcaattgtcgtgccaatagcagagctctgaaaacgtgatagtaattggttacaagtgcaaatcgactgccaggtttcatcagggcataggaaaatttcaaattttcttctgtgttggttgattggttttcgatgagaatgtcttcagcaggcactcctttctccaaggcataatttgccattgcctgtccttctgctatgagttcatcaggaccttgtccgcctgacatgatgagcttgctgccaggctgtttctggtagatcgctatgcctttttcaatccgcgaagccaaaagtggcgttaccttgtcaccaatcagacctgctcccaagaccactacataatcaagcttgcctgggaaaaaattgaccaaattgacaaagctagacatggtatagagcatgctgatgataatggcataggacacaaaaaaaccaacgtacacaaacaccatattgaaaaagctgatggctgatagagattgaaccacaaagggagcgatgaagagatagaaagtcaaggctaccgccagtcccatggataggaaattatggaagcgaaccccttctctcttcaaaatttgaaaaccatttagataaagtgtgaaaagcaagacaaatggaccacttaacaaggctaaaaagagcaccatagccactgctatagccagcaagcgcaagatttcattgtattcgagaatgcctgttgagataatccatgctaaagcccagacgaggatgttcaaagcaaacagtgagataaaaatcgaccgccgctcccagaaatagacaagagcaaacagaccgatagccgctaaaaataaccagaaaaagactgtcaagactagtttccccctgctaccatagacttaatgggctcaaaggtcttacggtgaatgggcgtgatgcctaacttgttcaagccttccaagtgctctgtcgttccatagccagcattcttggcgaagccgtagcctgagaactccttgtcatagtccgccatcatcttatcccgcgtcaccttggctacaatagaggccgctgcgatagataggctattggcatctcccttgatgatggaagtttgtggtatgggcgtatccaacttcatggcgtctatgagcaagtggtcaggtttctggcttaatttccccaaagcctccagcatggctaacttggttgcctcatagatgttgacctcgtcgatgagagctgcatcttttattcccacaccgactgccaccgctcgctccataacctcttggtagattgcttcatgcttggacttggggattttcttggagtcgttgaggtagcggattttgcaccctttaggcaagataaccgccgctgccaccacaggacctgctagaggtccccggccgacttcgtcgataccagcgatgaactccaccccattttcataaagggatttttcgtagaatagcatagcttctaagcgggcatcttctaccgcttctttttccagctccttacggcgtttcttgatagcagcctggacccctgctcgctcatcctgagccagttggtcccagactggactgtccagactgtctacctgggccagcagagctgtcacttccttaatcgttgccatctaagtcactcaccctgtctaatgtataagtacccaagcgaccgtcccgaacgtccttgacaaagaggttgtaaaaacggtcataatcatcacgaaagcccaatttcttggtccagtccatgatgagttcaggtgtttcctgctccaaatccatccccttaaatcgctcttgtagacgttctgggtagttggctttgaagtagtccaaaccaaaaatagtcacttcatccataggcaagagctgatccttaatggctcctgtcagagccaacttaagtccaacttcctggtcctcaaatttaggccagagtatcccaggtgtatcaaggatttcaaggtccttgttggatttgagccactgttggcccttcgtcacacctggtttgttgccaacaacggcgattttcttaccagccagacggttcatgagggtggattttccagcgtttggaataccgatgatcatggtccgcaaggtttctttttgaatacctctctcgcggaggcgttcaatcttgtctttcatcagacccttggctgcgtcggtcacctttttcaccgtcgcttgctcttttgagttgatggcaagggtacggatgccttgaccttcaaagtagctctgccattctttggtacgaacagggtctgctaagtcgaccttgttgagaatcatgagcttgggcttgtctccgacaatcttggtcaacatggggttttggctggataggggcagacgggcatcgaccaaaatggtcacgaaatcaacgtgcttgatgttctcctgcacctgcctgcgagcttttgacatgtggcccggaaaccattgaataattgccatggggtcctcctaaatatgattcattgaaaaaagccgtaaaaacggcttgtttttttattattatagcagaaaatcaatattttgtcttacttgttcctcttaaattctctcccgtaacttttcgacaaagagataggctgcgggacaaatcagagtattttttattgttaaattgttgatttgataaatcttcttgcggtcagtatgtggaaattctcgacaggctttgggacgagcatcatagatactacatagattatcgcctccaaggaagggacagggcatggattgaaataccttatctccgtcctcatccatacgcaaatacatatcctcaaaaactggaagtttcatgcgcaaatgcttggcaattcgggtaatatctgcttctgtaaagagtggtcccaatgttttacaacagttggcacactctgtacagtcgatttcagaaaatacttcggcatgaatatcttgaacaattctatccaaatttttaggtgttttcttcttcaaatttgctagaaattttcgatgttctccttgcttctgctgggccaattgcttgtatctttcaatgtcgacggtcataatctctccttttcgtccactattataccacaaacgaatggttaagctctgctaattttcaaaaccttcttcagaaaaaatcctgcaggaaacttctgctacaggtagaccaataatggtgtgaatatccccagaaatacctgctacaaagcgtggatccagctcctgaataccataggcacctgccttgtcgagtggctgcttttcacggatatatgattgaataacctcttcaagggctggataatagtcgacaaaatcaatctgtgcaaccgtataaaaaacatccagtgagtgtcttgtccgtaggcagacagatgtaacaacgtgatgactctttccaaaataggaacgtaacatggtttcagcttctgtcaaatcttgaggcttgttaaaaatttgcccatctgacactacgattgtatccgcagaaatgtagagatgaccagttaccaaatccatgtccgatttggctttggaaatttcacaacaggtttttgcagctcgagtgagaaaatcatctgtagcgaattgtttcataaaatgttcttcgataccacgctcatccacttcaactgatgcgatttgtggttgtaaaaatcccaataattgtttacgacgtggggagttgctaagcagaacgtaagaactaatctgctcacaatccccctctttttgatattgaaatacagtttgcatgtttcctccagtcaaaaacagagtccgaagaccctgttttcagatgattgattaattttcttttctacgacctactgccacggccagtcctgcaagacctaaaccaaacaggctgagcgtcagattcatctgatcaccagtatttggcaagactcctgcttttgtagtttttgctggacttgctacttctgtttttttatctcctactttcggagaatcaactggggccttcttgtccgttgctgaagtattttgtacttgattagatggtgaatccgtattttcggctggaacagtttctggatttgaggctggattttctggatcagtatccaataaaatttcgataaagtctgggtagccatcttcatccgtatcaatgcttgaatttacaggaatgatacgtgaatatgggttgacaacctcataagctgataagtcagctgtctttaggtattcagcaaagacgctgtccattgaaggaccttcttcacgtgctccgccaagcattgtgtagccatcaccaccagcagcaaggaagtcatttgttgctaaatagtacgttttttcaagatccaaggcgtcatattcgccagtctctggattaagaataccgataagaagaacacgttcttctacaggaagagttggatcgtagaatacatttgctcctgaaatgtgtaggaatccaccactagcttcaaagagcggcatgccattttcatctaaaagcatctcgccagtttctggattcacttgcaatgtagatgataaagacttggtaaacatatcataaatttgctgaccagtcacagtgatttgagaaacaatgttaccaaatggcaagactgcaataatatcaccttttgtaacaggctgatctttagcaattgttgcacgtagaccaccaccgttagtcacagcaaggctagttttgtttgaaaatcctgtttgaccataagcatagatcgcatccgtcactgcattccccaagttggtttcgcgaacacgcacgtttgagcggtctccgtttaattccactgggttattttcaataactacttgagcattttcagcttcatattttgctttaatttcatcaaccaaggctgcgattttagcatttggcgtcacatttttagtatccgcagcagaaatcaagctagcttcacccaataatttatcggatttcaaggttactttaccgatattgttcaagtaagagcctgtttgattataagtaacgttatctccataggtagtcgcttctaccgtgtgggaatgaccgtcgataacaataacacgtttaccagctaatttactatttttagaaagtgcttcagcaagagttgaacctctccattcaacaggcgttgtagaatcgacacctaggtgagctagaatgatatagttcttgtaaacacgattatctgctagagcgcgcgcttccacttcgtcaatcactttattgacttctgtgactgggtcggtaaatgttactccctcaacatttttcggatgggtttttgtagcagtttcaggtgttgttacaccgataactacaaattcatcgcctacaacagttggagttttatcgacaatagttgaagcttcaaaaacacgagcaccattaacgtaagtgttagcactcaatagcgggaagttcaaggtttccttgtacttgattgcttgatccatcccaaagtcaaattcatggttaccaacagccattgcatcatagccgacttggttcatgatattggcgcggtcttcaccttttgtagagttggaaattggaagtccttggaaggcatcaccagcatctactacaattgtattttctactttggcacgttcttcttcaatgactgccgcagccttagcgtcaccgatgacattcttttcttcaagaatgcgaccgtgaacgtcgtttgtgtggataatgactgcctctactgtttcttccgcagcagggacaacagtttcctccgttgctacgttttcaactgacgttgctggtaccgtagcagttgcatcagtcgttgctggtaccgtagcagttgcatcagtcgttgctggctgattggttgtggtagctgcagtcgttgtctcagcagcttgtacttgttgagctaaaacaaatggcgccaacaagagtgtggacattacaggcaacaagatttttttctttttcataaatagacctttcttcggcattttttatatctctattatacactttttatcaaaaaacaaaaacattaaaatcgcttacatgttaaaaaggttcgaaataagcgaattagctatctaatccgctcatttcctatttaccaaatactatttgtccatttgcaatggtgtaaaggacctgtcctttcagactatcaccaacaaacggagaatttgcagacttcgaggcaaaatccgctgtgaccaaccgatttgcatttgggtcaaaaataacaagatcggctgggccattttcagcaagatagccagcatcaagaccatagagcttggctggattaatggtcattttctccaacaattgtacgagtgtcagatgcccttcttccaccagatgcgtcaaaccaagtgaaagcgaagtttccaagcctgtcattcctgaaggagcttgcgtaaggtcctctacatttttctcatctgggtgatgaggtgcatggtccgtcgcaatgacagagataacaccagatttcaacccatcaatcacagccaagcgatcactttctaatcgtagtggcggattcattttagcattggcaccttttgttagaagtaattcttctgttcgtgaaaaatgttggggtgctacttctgccgtgacgtttgctccgagaccttgaacaaattcaaccaccttgaccgactcggctttggatagatgctggatatgaacacgcgcacccgtttcataggcaatcatgacatcgcgagcgaccatactgtattctgctacgcctgttgctccacaaacatgaaaatgtttttcagctacttgctcgttgagtcccaagacaccattcaggtcagggtcttcttcatgcagactgatgagacagccctgctctttggctaatttcatagcttttctaaccacgccagcatttgtcaaaggaataccatcgtccgaaaaggccaccgctccagcttctagcaaagcaggaaaatcggtcagattttgcccatcgaaatgatctgtaatggttgccacactataaatatggatggcttcttttttagcagaatccaatacttcttttaaggtttcaatatttgaaatcgtcggactagtgttagccatcatgacaacagaagtaaaaccacccgctgctgcagaaagagctcctgtatgaatatcttctttatgggtctgacctggctcccgaaaatgcacatgaacatcaaccaaaccaggagcaacgactaatcctgtcgcatcaatcacttcttgctcaacatcttctgaaatcgactccgcaatcttaacaatcttacttccgtccatcaagatgtcgcaaaccttgtctaaaccggattgcggatccaatactcgaccatttttcactaataacattcatattctcctttgtagtaccaaagccattaccatctactatcgcagccaatcaattcctgttctgccttgtgaagtcaagtaggcatttgcttgtgagaagggcttgcttccgaagaaacctcgataggctgaaagagggcttggatgagcagattcgataaccagatgttttggattggttatcaacgcctttttcttgcgagcataagcaccccaaagaatatagacaacaggctggtctaagctattgaccaccttaataacagcgtccgtaaaaggctcccagatttgccctgcatgtccatttgcctgacctgctggaacagttaaacaagcattgagcaaaagcacaccttgttccgcccatgctgtcaaatcatgatcttgtttgacgccaatatcatccgtcaattcttttaaaatgttttgaagagatggcggagctggtaccgagttcggaacagaaaatgacaagccctgtgcctgaccaggtccgtgatagggatcctgtcccaaaataactactttaacctcttccaaatccgttgtttgaatggcagcaaataccttctcacgaggcggataaatggttccaccagcataaacatgatctaaaaactgattaattttaccaaaataatgctctggcaactgtgcctttatcaattcgtgccaagctgaatgttccataaactgctcctagtttgaacttttctctttaacaatataaatcggacgtttcttcgtttccaagaaaacttttgccaaatatttaccgagaataccaatggtcatcaactgcagacctcccaaaaataggatgatacaaatagtcgacggccagccaattgtaggatctccgaacaccaaggttttgaaaaccacaaaaaccattagaactagcgacaataggaaggtgaaaaaacctgtataggaggcaatattcaaaggtgtatctgaaaaattgatgattccttcaatagaataagaaagcaatttccagaaagaccaactagtttcgccagcgaccctctcaacattttcatagggcaagtattctgtttcgaatcctacccaagcaaaaattccttttgaaaagcgattgtattcagacacagatagaatggcatctaccatgtgacgacgcatgagacggaaatcacgggcaccgtctactacctcgacctggctgattttattcatcaatttgtagaataattttgcaaaaaagctacgaatcggtggttcaccatcacgactgacacgacgggttccaacgcaatctaaatctggatttccatccaacatagccttcatttccatcaacatttcaggtggatcttgtaaatcaacatccatgactgtcactagctcaccttgcgcagcttgtagacctgcatagagagcagcttctttcccgaaattccttgaaaaggaaagatagcgaacagctcggtcttgaccagacaattggcgtaaaaccgttaatgtcccatcctttgaaccatcattgacaaaaatatactcaaattgttcccccatctccttacgaactttctccatagcatcgtaaaaatagggaattgcctcttcttcattaaaacaaggcacgataactgaaatcatgttcttctcctcatacggtcaattattgtattctcaaaatacgttagagactattataccattttacaggataagttcccagaaatcgtgcgtgggctcgttttaaatctagtcttcctgccaagtttcttgattttgacggaactttttaagcagattcaaaccatctgcattgatatatccctgtacttttgcgaccttgattaactctgaataattgctaagcgtcaccaatttcacgccagcattatcaaaattacgatctgcctttggcaattcataggtaaagattgccacaacaccaataacgtcagcgccttcacgctcagctgctgctacggcatctagaacagaccctccagtagaaatcaggtcttcaacgacaaccattttttgtcccttgacgatgcgaccctctaattgattccctgcaccatgatcttttggtttgctacggatataagcaaatggcaaattcatccgatctgcaatgatagcaccatgaggaatacctgctgtggcagttccggcaatcacctcaacctcagaaaattcttctttaatacgttggacaaagccatcttcaatcaaatttcgagtttcaggataagatagtgtaatacgattatctgtatagataggggatttgatacctgatgcccatgtaaatggcttttctagacgcagatgaactgccttaatatccaataagtgtgatgcgatttctgttgctagtgtcataatagacctccttctaaatgcgtaccattccaacatgaccatcccgccgaatagcctgtcactcctaaagtactggttcaatctatgaaccctacaaaaaactatatttatccctgttgaattcttacagacttctcctagtccaccatttcaatccatgaatcaaaatactggtcaataaaattggttttctcttttatttctgtcacggtaagtttttcatcaagacctgtcagaacccatttatcctcgatatcatctctgcgatgtataatcgcgaccaatttcccctcgaaagctgtcaagggctgccgaacagctttggaaatgatgtaaacatcttgctcttcaccatctccagccaatagatttggaacatagccgtaattgattggatactggttgccaaatttatcaatatacccgagaggtctatcgattataacctgataaatcttatccacgattccactcctctttaatagacaaataggtctggtaaggatgttctgattttgtaatcgggcgacctaccacaatgtaatcactaccgattcgagcagcatctgctggtgtcataactcgtttctgatcgcctacttcaccgccagtcggacgaatccctggcgtcaggcacacaaaatcagaacttgtagcatctttaatcaaagccacctcatgagctgaacaaaccaccccatcaagaccagcttcttgtgctctttgagcataatgaacaactgcttcctgcaaactagtctgtatattctggtccgtcctcatctgctcttctgaggtagaggtcaactgagtgaccgctattaaaacagcatccttacccaatccccttcgtgctgcccgcatcatctcaacaccaccagcagcgtgaacgttggtcatatccacaccgagttttgccaagactttcatagcagactcgacggtattaggaatatcatgcagtttcaaatctagaaaaatactgtgaccgcagtctttcaaataattgataatacctggtccctccgcataatacaactccattccaacctttacatagagtttctcatctggtgggaactgttccagaaaagactgaacttcttctttacctgcaaagtcaagggcaataattggtcttgtttctttcataaaatcctttcatttacacaaaaatccctgccaaatcggtcagggatgtgcacgaattcagcttgaaaatcacctttcaagcatattacatgacaccttcctagcctctctggacttagttaaaggagatattttctttatattactcttttattttacctttgtcaacgcttacccaagctatatctgatttctcggcgtaaaccttccaaactatcaataccataaacttccatgcgttttggcaagtcttgaataatctttggacaagcaaatgggtctgtaaagttggctgtccctaccccaatggctgaagctcctgcaaccatcatctctatagccttgtccgccgtatccacaccacccataccaataatcggtaaatcagtcatctgagcaacctgacgaatgagtttgagagcaaccggaaaaactgctggacctgacattcctcctgtaccatttgccaagattggttgtcgagttttgagattgaatcgcataccaaccaaggtatttatcatcgtcaagccagtcgctccagcagcctcagcagccttggccaacagggttatgtctgccacacttggtgtcagcttaacgtaaacaggtacagatgaggcttcgactgctgcttttactgcttgataggctaattctggcacctgtccaatcaagagaccattatttccgtggtccacattgggacaggaaatgttcagctcgatagcttttacgtttggagcctttgaaattttccctgacacataggcatattcctcattggaaaaaccagccacattggcaatgatgggcaaatctgggaaatgttgctctaaccatggtaatttttcggataagaccgcctcaacacccggattttgaagtccaatggcattgagcatacctgctggtgtctcggctacacggggagtcgcattgccataacgaggatgacgggtagtcgccttaatcataatagatccaagctggttaaggtcataataatctgcatattcctgaccaaaaccgaagcagccagaggctggaatgatgggatttttcaagtccaagcctggtaaggaaatcgctaatcgttttgtcatttcaacctcctacaaaattagactacctgtcgcaaagactggaccttccttgcagacacgcttgttctcgtgttcttgtccctctttgggtttgacaacacaggcatagcacgcccccatcccgcaagccatcctagcctccagtgaaatgtaggcatgaggatgttcctgaaagcgttggtcaacatagttcatcatagcaggtgctccacaggaataaatggctgcaaactcgtttgtcagctcttcaacgaccgttgcaacattccccttacgcccataggaaccatcatccgttgtgacatagaccatcccataacttgccagctcctcttccaaaatgacggcctctttggtggcaaagccaatgactgacgtgacattgacaccacggaacgcagcctgtttggctacttccaccaagggaggaacaccgattcctccgccaatgatgagaatgcggtcaccttctttgagaaagtctacttcaaactctttcccaagcggtcccataacatccaaatactgcccgaccgtcattttcgaaaagacttccgtcccttgaccttccactcggtaaataatccgacattgagacttattccgatcaatctcggaaatagatattggtctccgcaagagcatggaatcatctgggacacgaatatggataaactgccccattttcatatcttggaccatatcaccctgcaaggtcatagcaaaaattcgtggcgctagttggacttggtccaccagtaacatctgttcttttaaaatcatcttttctcctattctatataacaatgacacagaaaacaagaaagtcgatatagagaaaaaaccttgctggctagcaaggttacacgaaaagaaggcagtatttgccctatttatcacgttcccttcttcgcctctctggactcagttaaaggatatattttcagcattatacattttttagaataatttgtcaaatcatgttacaatggaggtatgagaatccaacaattatactatattatcaaaattgcagaaacaggcagtatgaatgaggctgccaaacaactcttcattacccaacccagcctttccaacgctgtacgagacctggaaaaagaaatgaaaattaaaatctttttccgtaattctaagggcattaccctgacaaaggatggcatggagtttctttcctacgctcgtcaaattgttgaacagacagagcttttagaagatcgctataaaaatcctaatgcaaaacgccaactatttagcgtctcttctcaacactatgcctttgtcgtcaacgcctttgtctcacttttgaaagaaactgaaatggaagattatgaactcttcctacgtgaaacacggacctgggaaatcattgatgacgttaagaattttcgctcagaaatcggagtgcttttcctcaaccatttcaaccgtgatgttctgctgaaactgttggatgacaatcgactatcctatacaactctcttcactgccaaaccacatgtatttgtcagcaaaaccaatcctttggcacaaagaaagtcaatcactctcgatgatttggtagatttcccctatctcagctatgagcaaggtattcacaactccttctactttgcagaagaaattctagcccaggaacaccataaaaaatcgattgtcgtatctgaccgtgccacactcttcaatctcttaatcggtctagatggctatacaatcgcaacaggtatcctcaattcaaaccttaacggagataatattgtatcaattcctctggaatttgatgatgaaatcgaattggtctatattcaacacgaaaaggcattgctgtccgacatgggagaaaaattcatcaattacctacttgaagaggtaaaattcgaccaaaaataaataccactttatatagacaaacaaaatacaatatgttatgatacatttatgaaagacgttgaaaagaaaaatgaaaataattcacttttctttaaggaaacgctttcatttttttatactctatgctataatacatgtatcatatatattaaggagtggttagatggctcaaaataaaatgttagctatgattcttgctggtggacgtggaacacgtctagaagggttgacaaaaaaagtcgccaaaccagcggtcgcatttggcggaaagtaccgcattattgactttcctctcagtaactgtgccaactcaggtattgatattgtcggagttttgactcagtatgagcctgttctcttgaactcatacgttgcacagtctcaacgttggggacttgatgtacaaggatctggcgtctttgtattaccaccgagtgaaaaaatcgaaggtttcggactttacaaaggtacagccgacgctattacacagaacattgatttcattgatcttcacgatccagagcacgtattgattttgtctggtgaccacatctataagatgaactacgacaaactccttgatacacatattcagaaaaaagcagatgccacgattgcggttatcgaagttccaatcaaagaagcttcacgttttggtatcatgaatacggacgaagattaccgtattgaagaatttgaagaaaaaccagaaaatcctaagagcaatttagcatcaatgggtatctatatcttcacttggaagaccttgaaaaagtaccttcaagaagatgacaaattggacacttcatctcacgattttgggcacgacatcattccgaaatacttagaagatggtcgcactctcattgcccatccattccgtggttattggaaagacgtaggtaccgttaacagcctctgggaatccaatatggacttgattgatcacgctggagatttggacctttctgaccgctcatggagaatctattcagaggataagggatctcctgcccaagtcattggtgcaactgcaacggttaaatctgcctatattgataaaggggcaatcatcgatggtactgtagaacattctgttatttcaacagatgtgcaagtcaaccaaaatgccgtagtaaaaaattctgtcatcctacctggtgctattatcggcgaaggtgttgaacttgactacgtcatcgtcgctgaaaatattaaaattgccgacggagttaaactcacaggagacatcgaccatatcctcttgattgacaagaatgtgaccaagtaagaaaggactgctatgctaagaaatactctcggaattgtaaatattgaaggaaacaacgtacattttggtgacgtgatgaagcaccgtggcgtacaagctttcggtttcttaggtcgttatcgcctaattgactttgctctatccaatatgtcaaactctggaattacagaattccaagtatacatgcctgccgaaatgcgttcaacaattcagcacgttggtacagggaaacactataatatcaacagcaaacgcggtacccttcgcttgctcaatagcgcaacagacccaaatagtgtctatcgtcacgatattaatgccttcacagaaaacatccactacatcgaaaattctacaaaagattatgtgctagttgctccatcttacttcatctatagccaggatttttcaaaagtcatggatgaccatatcgcaacggatgctgatattaccgttctttataaaaacgtttcagatgctaaagaaaatttcatcggttgtcaaactctcaaatttggtgaagaccgtcgtgtcgtagcttttgaggaaaaccatggtaaatataaaaaccgtcccgtttcccttgaagcctacattatgaaacggactacatttatcgacttgattaaacgtgctaacaaagtgtcgtctctctactggttaaaagatattttacgtgatacagttgaccagtacaagattatgggctatgcacatcgtgattatgtcgcatgtatcaatacgacagcttcctacttcaatactcaaattgaattgattgaccaagatacccgcaaactcctcttcaaacatgattggccaatccatactcaaacaagtgatagctcaccatgtttatatggtccattggcagaggtcaaacgtagcctaatttcaaatggagcgaatatcaatggtcaagtcgaaaattcagtcattgaccgcgatgttatcattgaagaaggtgttgttatcaaaaactcaatcattctcaatggcgtgacaatcaagagcggggcgaatattgaaaatgcaattatcgataaagcaactaaaattattcacccaattgacatcaagggaagcgaaacttcgccttcatacttgaaaccacaccaaatcatttaggagctaacatgacaaaaaaatctgttctctttgtagcatccgagggacttccattcatcaagactggcggattggctgatgttattggctctttaccaaaagaattggtaaaacagggtttagatgtccgagtcgttctaccactctacaaaaaaattgcagtaaacaatcactctgatttcgattacgtatcaagttttgatgtgcgggctggcgacatccaatctatggcaaatgtttacagtcaggttgttgatggagtaacattctattttattgaacaccgcgatttctttgaacgcgatgaactatatggatacgacgatgatgccatgcgttttggctatttccaacatgctacatgtcgtctgttagaagcacttcatttcttcccggatgtcatgcacacacatgactggcacactgctgcccttccattcctttgccgtactttctatagctaccgcgaagaattccgcaatatcaagcatgtattcactattcataacttggcttttcagggtatttttcacaaacaagcactttggtcagcgcttggcatggactatagctactatttggatggtattgcacgttttcatgatgaatgtatcagcttcatgaagctgggtatcctatacgctgacaaggttactacagtttctgaaacttatgctcgcgaaatcctaacggaagaattcggcgaaaacatgcaacatgtactagagttgcgcaaatatgacttggttggtattgtcaatggtatcgactatgacagttgggatagtcaaacagatcagtaccttgtgagaaattatagtcttgaaacgattgaaagtaaaaaggctaataaactggccctgcaatcacaatttgcccttccacaagatgagaatgtcctattgataggtatcgtctctcgtttgacatggcaaaaagggttctacctcttgaccgaggtacttggccatcttcttcaagcccatgtccaatttgttatcttaggcaatggtgaggaagacattgaaaatgcctttaatcactttaaacatgcttatcctgataaatttgcattctaccgtggttacaatgaaccacttgcccaccaaatttatgcagcaagtgatctcttccttatgccttctatgtttgaaccatgcggcattagccagttgatttcaatgcactacggaacactccctctagtgcgtgaaacaggtggcttggttgatactgtagcaccatacaatatgtctaccaaggaaggaactggctttagctttggagggcgtgacgcttacaatatgcgacaagtctatgatttagcccttcaaacctactatgaccgtcccgatgactggtatgccatggttgaacaagctatgaagcgtgattttagttggacagcttcggcagagaaatacatctggctctaccgtgaaattagtggttaggaaataagatgaaaaaatatactgaatcggagtgggaccctagtccactccttttcggcaatggagattgctatgacagaatttactgacctagatttatattatatgaatactggtgagcataccactctttacgaaaaaatgggtgctcatattataaaagaacgaaacaaaattatcggaacccaatttcgtgtctatgccccaaatgccagagaagtattcttagttggcaactttaacgagtggcaacgcagtcactctatggagcgtgaaattgatggagtatttcaactttatgtagacggattaaaatcccttgaagattataaatacctgattatcacacacgatgggcgtgaaatatataaggctgacccttatgcatttttcagccaagttcgtccagacactgcctctacaacctacaattcgcgttataaattcaaagatgacatctggatgtataatcgtgttaactatgattttaaagaacagccagtatccatctacgaggtgcacttaggttcgtggaagcaaaaatttgctaataaaaatgaaggaggagctcctgtagaagctttcaatagttataaggaaattactccacttctcatcgaacatatcaaggaaaataactacacacatattgagttattgccaattaccgagcatcctctcgatgcgtcttggggctatcaggtaacaggctactacagtccaactagtcgctatggcaagccagatgaacttaagtatttagttgaccaatgtcaccaagcaggaatcggagtgattcttgactgggtaccacttcatttctgtaaagatgctcatgggctctaccagtttgatggtagttggctatacgaatactcctacgaacaagaccgtgaaaatcaccagtgggggactgctaattttgaccttggaaaaggactgactcgttctttccttctttctaatttaaaatactggttggaatatttccattttgatggcatccgtgttgatgcactatcttatctcctctattggcgtggtgaaacagatgaagataagataaatcatgccgcaattgactttatcaaacgtgtcaatgccatggtccataccgactataagggagtcttgatgattgctgaagactcttcaagcttccctaaagtcacacatcctctagaagatggcggtattggatttgatatgaaatgggatctgggctggatgaatgatacactaaaattcgtggaacgccctgctatttatcgaaaatatcactcaaatgaaatcacttttggtatgtactataaccaaaacgagcaattcttactaccactttcgcacgacgaagttgttcatgggaaacactccattatcgagaagatgaatggcgactacgaagataagttccatctggctcgagtctactacagcttttactttgcccatcctggaaagaaattactcttcatgggaaatgaatggggtcacatccgtgaatggcacgaatatacagaaatggactggggactgctacaatttccaatccaccattctttctatcaaatgatgaaaacactatctactttctataaagaacatgatgctttctggaaatatgactaccaagcctatgaaaaaggatttaattgggtaaaaatagatgaagaagcaagcctgtatgctttttctcgcactagtgatgtgcaagaaatcttgactattcataactttaatgatcaagaactatttgatgtacacttggatttgccagctgacagcgaatataaacttgtcttctcatctaatgctattccaatggacacatttagcctctatcccgatgaaaatggagccagaattactgtaccacgtttgaccagtttttatctagagcgtgtgaaataattatctataaaaaatggagtattgaaccgacccaaattttctgtctaacttttggtgtgtggctcacttactccattcttttttgcatgcaaaaacaaccaccgtttccgatgattgttcatttctcttattcaacacttgtatatgttgcagctttctcaaggaaagtatcaaactcaccacttgcttttacttctgcgataaccttgtctatcgcagtttttagttctgtactaccttttggcaaagcaatgactttcgaattctcatcaatcgttggaaattcaacggatgcaacggctaaatctgaattctgtgaaacataaccagcagcaactggagaatccattaaaatagcatcaacttttcctgatttgagctcatttacagcttcacccatcaaggttaaagaaattaggttagcttgactaatgttttcctgtgcataggattcttgtgttgaacccttttgtaccgcgagagttttcccgctcatagcatcaattgaagtgagtgaattggcgctatcttttttgataagtaatacatcagaaatttgatagtaactttcagagaaatcaaaaacttttgcacgctcttccgaataagatagaccagcaattgcaatatcagctttgccattctgaacgctagacaatacattgtcaaaactcattgctgaaacttcaagcttgaccccaagttcgtcggctattttttgagccaacataatatctgcaccaacaacttcattctttccatcaactagtgcctgaaactcgaatggagcatagtctggactagttgccactactaatgttcctttttctttaattttatctaatgcggattgtgatgacgtcgaagaacaagctgccaatgtcagtccagctaaaactgttgctgctaatgccaagatttttttcatatttcttaaataccttctctttattttaataaaatacttattctaaaaaacagaagcttattgattttcattgtattttcttgcagtttttcagaatgtattctcattttaattcatttttatacatttgtcaagaaaatattatttttattcactttaattgtataaaatttaattattagcaatggataattcataggcttcttgaacaaattgatccatctgtccagattccactagttttgtaatgacagagtcaactttttcctttaaagctgtacttccttttggcaaggcaatagcataggcatctgaatagctactttttatctcagtatctaaaataaccaagtcatcatttttggcaacataagctttcgcaatcggctcttcaaaaataactgcttctaccttctgtgattttaattgattaattagctcgccgttcgaagctagagcaataaccgtggaggacggaagctgttctttaataatttgttcttgaatagaacctttttgtgctcctatatttgcctcagctagagaatcaagcgatgtatattgtgcaagatcctctttatttataataactttattggttgaggtgtagtaaggaatggaaaaatcatacacttttgcacgctcttcagtggctgaaattcctgaaatggcaatatccgattgccctgactggacattgttcaaaacattatcaaaactcatcgctgaaaattcgacttctacacccaattcttgaccaatggcttttgcaagctcaatgtcagctccaacgattgtatcttttccatcaaccagtgttctaaactcaaatggtggaaattctggattcaatgcaacaattagttttcccttttcctgaacatccttcaaggaagtatcttcttgagtagcatttccactgcaagcacttagggtcatcgttgccaacaaaaccaatcccatcataatatattttttcatcatcatattctcctttaaaataatcctgtgcatacttataccgttttttatataaaacatcggacttccattgtagtaaaatgcatattttttctccttttttgaaagataaaaacattttatgtcatttttatacatttgtcaactcatttgttgtatttttattcaaacaacataaaaaagaagctattcctagcttctacctaaaattcttgtcccactctccatcgtcattttttctagtataaaagaactcggacaaatctggctcatccatgactttcaggatttctagtaagtcataggccaaatccatctgaggcagttccgacttctcaacccaacgcacctcgccttcttcagttgatcggatagttcctgtaaactctgttgccttatagagaaatacaatgtaacgatgcccttccttatccggccaatgtttaagaccaaccaagcgagcatcagtgactgttaaacctgtttcttcttgcacttctctaacaaccgaatcatggaaattctcgccttcttcaatatgtccacctggaaaggcaacaccagaccaacgataacgcttgggatctcgaatctgtacaacgaccttcccttccttatcttcgattagacacatgttagtcaaagtgaccatttcttttctagccattttctctctctttctgtttaaaaatcattctatattctgtacgttctgcacctaaattgaccgtttttttgacaccatcaaatcggaagcccactttttcatagaaggcaatggcacgcgcattcccctccaatacccagagaataacggtttcgtagctctgcaatttttctaaagctgcctgcatgagctggtagcctatcttctgattataatagtccgccaagacatagagggcgtagagctcccctaccccttgcaaatcctcctgactagatgagccgtaacaggcaaagccaacgaccttatcatccatcacagctatcaagatattctgaggataccgaactgcccagtcttgacagcgttctaaagtgtaagtattctttaaaaattcctgaggtaacaagtcagcataggcctcctgccatgatttccaatgaacataggccttgcctagcatttcacttttcgtttccagtggtttaatcatcatctaaaggacctccgaattttttcctctagtatacattaaaaaacaagttggcacaagaccaacttgttaatgattatttaattaaaaatcgatgttctgaagtcatttgtagagttcatcaaggcttgataaactttcactttgagtgcatgaacacgactgttgttcaagttgaggctgttcgcttggatgtctgcttccatggcctctttcatcaagttttgcaactgctcaaagcttgtgatagttacttccttggttgaatcagcaacaccaagttcatactgcatggtaaacggcttgagttggcctgtcgctgctttttccaaacgctcagtaaacatggctttcttaaactcagcccatgaagtatattgaccttggaagacatattctaagacatggtcatccgtaatcaaaccagtattcttcttgttccaagtatcatagatgattgagcctttctccatagctagatcagacaactggccagaagcatacggtacaaaaccatctgtgtaccctttggcagcaattaattcaaaggccatacggcggaacatgatgtcgcctggagaaccgtttgagtttgaaagggctgagaagttagctgcaaacattggaacgctgacataactgtttctatcccacttcttgcttgtgttagttggattgttgacatattggcgttgaacaataatgctctgatcaatcaaatcattgaaggacttcaagcttgccacttcggcatctgtcaatgcacgcgcagaatttccagcatgggtatcaacaccattattttggacatagtagttttcaatcttacgcaaccaagctttcttgttagcatctgattgagccaagatgtttgtaccttctaggtaatccagcaagtaaagtacatcaaattggttatggtaatactcattgaaatcagcttcgctattgaaacgtgcaactgggtctccgacatggacacggttggcatcatcgctattatagacagcgttgaatccaaggttcatctcagtaacattgaagacattttgtagaagaccttgggcgtaaacttccataccttgaccaatacggcggccatagcctttcagataaatatcaccatcttggttgtgaaccatttcgtgggtataaagagctgtaccgtaatccgtcaacatatcgtaagtaatatagtaggtctcacttccatccgcaaaggcagtcttaatagacggatgctcacgataccacttattgatcggaccgtagaaatcttggatagcatcaacatcagctgtcaagttgcgataagacttcgtaccatctttaccatacatcacataaccttcgttattgaggacagatctgaatagcttgtcacggttggtttcatccaaaatcttataccagaagtctgcattatcacgctgacgttctgccgccaaatcaaccatctgacgaaccttatcacgattttcaactgttgaataatcatctacatagtgctcatatgaaccaatcgcgatggtattcatgtttgtgatgataaagatattttcttgtggcaaagtcaagagtggcaagagcatgtggttgtacttccaagttggattggatacagtatcattcacaatcttgctataagctccaacattgtacttgctatatgtatctgtcgtttcctgcttagcagctacttctggaatcaaggatttaccttcaacaacataagccttggttgtttgcttgaaccattcattgttggtcatttctggcaagaagagctgacgataatcttccagcatatcgaaaagcttggtctgattattttgtttaccaatgatggatgcaaaagtggtcacgttattgtgggcacgaagaacatcatagccaccattaccaattgcaagaatcatatctagggcagatgctgcatcatttccgaagaagtcaggttcaaagatggtcaagtctttggtattcatctctccgaagttgatgtcataccaacggttcaagtaagtcaaaccgagcacaaaggctgctttgttgttgatgattttctctttgatgtagtcttcagaagcctgaccttgaccatttagactagccactaaaatcttacgaacattgctttctaggttggtcatcacttggtcatagctttcaccaaagtagaaatcttttgctgtaccagtctgagtatcggcattcaaggtcgttggataattgataacagccttcatggcatccgagtcgaggacaacagaagaaaggctgcttaccaagtcattgacaagggcacttctgtcattcaagaatgattctggcgtgtaaatcaagtccgtacctgaaatggtatactcgaccacatgattattcttgaagtcttctagataagaaactgtcttgtagtccacagtgccatcagcatagtgaagcataatcttattgatattagccttctcagcgtagacgtcagcaactacagcattgtccttcattggtacaacatccagcaaacggaccttgttgagcttatcgtctgtcgcaatcttgtttccataatagacaagaagttccttgttgtagaatggcaagattttctccatgttgtagtaggcagtttcatggtcagcctgtgccttatccaaggtcaagtagtctactgaataatgattgggattaagcggtacagaatcatcaattgtcgcttgaatagccatagcttctacttttgcttgtgcttcttcatcagtgataacagtgacgttggtcaagctatcagatgttgtagtgaaaccgtctttaatcttaccagttggatttgcgggttgaccgataatgcttttcgtaccagtcatatcgctgacaacgttgttgacattaccgctatgtggagcataggcacctgttacttggttggcaccagcaattccgccgacaatggctgccgattcagtcgtcacaatggaaccagctgcataagaattatagacacttcctggtacatcgtagacaagcattgtacgaccgacgataccaccagctacttgattctctgtacctgggagggttatggtcgcatcaaccttggcatttccgacacttgccatcgtaccgttacccaagataccaccagttagacttgcattggttccggttacttcgatactacccttgaaggatacacctttaatagtagtatttgttgcagaatgaactaaaccagatacgttttgcggtcctttgatagatgcttctactgctacgtttgtaatagttgctccattggcattaatcgcaattgtcgcaagtgggttcttagagcttgtattcaggcttgcatttttgatgtccaagttttgaactttaccaccaaggttaaagaacaatggtgctttcaagttgctgatagaaaaggcgtagccgtcatttaagccatccaaggtaccgctaaagttggtcacatacgatgcaacatctccaacaggaacttcacttgcgtccaaatgcgctcctagtttaaaggtaccacttggatttgccttcatagcgtcgagcaaagctttgaaggatgtgtaggtatttgcatcagtcgccatcttaggaatgtagaattcacgattggcaacgtattgggcatccttatcctgtaccaattcatcaaaggatgaaactagtttgaagactgccttgccattcaaggtagtttcttcaatacttgacacaggtaggtatacctccttgaagcgatctgaagtcaccttgataaacaattcatctgtggatgctggcagttcttccaagaattcttgaccgatgtagctaccattcttacgacggtaaacagtcaccgcatcaatatccttgatttcaatcttcttgtagaccaaatcaaatttgcgcatgctttcaagaatagcttcttgttccgaactttgttcctgctctgccattgtgtagaaaatcttagtcttaacagtgtaatctgtgtagaaatcaagattttcaagtgtcaactggccatttggatctgtaatggtctgttcttgaaccaaggcacctgtattatcatagaggagagcaacagctcgttggaaattagcggtttcgtctgtcaacttgtagctgattgtcgctgacttggcatcgtcattttccaccaaatctgtgataatcacttgtggtactttttcaacctttgtaccacgcgcaatgacttgcttaacaggttgtttggtaatttcttctgttacagtagaattttcctgacgaacacccttgatagtctggtaagttgttgtaactgtcttagagccatttacacccgccgttacaactttggtcttaccttctagcagtgttggatcatcaacatactctgtttcaaaggtaatctcaacttgattagtttcgatttccgtaccttctattggttttgttcctttgagaacctctttcgttgttggctcttcaaggactttctcagtcactgttgggtttggttgactgactccgttgattgtctgataagtagtggtaacttccttagaaccaaccttaccttcagtaatgaatttttcttccccaacataaagttcttctgtttctgtgactgtcgtttcaaacggaagctcttctgttgttacaatggtttcagatccaataacatctgttgtcttcgtgcctactcttacaacttctgttactggttcttttgtcactacatctgaaacttgttcggatttaatcagtacaccatcggcataataattcctagtctcgattgtccgaacaccatcttgtcccttctgttcaacttcacgactaccttctgccaagtttacatcatagatttcttgcacatcaaaggcaaagacttcggtatgagtaactgtttcttctgttaaagaattcgtcgagttttcataacttggttctgtatctggtacttctgtaacaatatcatcggttgcttgttttgtaccaacttcaacaatctttggaacagcagtttttgtaaccgtcgaggaaatctcttcttccgaaataatttgaccttttgaatggacttgtttaatcgttacaatacgctccccatcctgtccttcttgtaccactcgctctgtccccgcagataattgaggattttctacggtttgaatttcgaatggaatggcctctgtcttgttgacaatagtttctgtacggattccttctgaagctgggaattccgctgttttttcctcttccgaagtagtttgttcaatagctttgctatccttcaaatatcctacataaacgtagccatcaatctcagctggggccggtaacgcttgtccggcagatatttcgattgcatggttatatcgagccaaaatttgactcgtcaatgcggagctagttggaccgaagaagcttgctcccgtagctgtcaaaaggatgacacccgccaactccttcttaccttttttaccaaatctaacagccaataacaggagagacactccacccgccaccaatagttcggtttctacagagccagtatttggcaaaacttgagacgtgcttgtcgatggagtagatgttgtgccagtagctggacgatagatcaggtaataatttacatccgtttcctgagctaagccaggcaagtcacgaataatcaactccttttctccatctgtcaattcttgctctgtcacataggaataattgattgattgagcactagcagtcggtgctgttgccacagaggacacaaaaaatagacttgtcactgccgctgagacaagtcccactgacatttttctaaaaccaaagcgttgtcgcttttcacctaaagatcttttcatataagttgttactccctaaaatagtatagaaactattatacctattcaatgatgctcctacaagttttttgtcttattcaatgaactattttcaattcaaatctgatacaaactaagcaatgttcataaaaaacgacaggatgcagtaccctgtcgctttattctttcgaatctacatattcttcaactcgataaccatatcacgaatctgggctgccagttcaaagtcaagcacttctgccgcttcctgcatctgaccttccagtttcttacttatggtctaactcaattcttcgtagcttttcaaaagaggttatcgatacggaatacttgaagtttcaacgataatgtcaggctgaatgtaatggatataaggagctatatagtctacattttcaacttttggccccaacataatctttgaatattttaatgggacaacattgatgtacgcatataaattacatttcccttgttctgttttttctatgtgaatatattttctgctgttcagataattcacattcttattttctaacaatcctatgccaatatctagtttcctacgtgtagcttcatcttttattccagagttcaatttatcagtgaatttatcagtgaatttgttagtgaaatgcgtatcatctaagtttaccaatatacgatattcagattcatattgataatcagaaaccttaaaaagataggatatcttagcaatataatcaatgatttctcgaatttcatcggttgctccctcatcttctaaatacttaattgtatcttgaatatatattagtttttgatcaactagtttatcaccagtaatattttgcttttcatctgtagtaatataatgaactttagcaaattcaataacatcatgcttgacaatagtttccaagtaatcttgatcatattccagaaatgctcccctagactcctcagcatattctttccacataggtaaactatctttaacaactgtcaaggatgaaagaaacacattggttggtttataatactgttccatatgggcatctaaaccaaggatggcgagtaaggcttttccttccatcggatcattcaattgattagcatttgacaaacgtaaataggttggacaatttttattttcttccgtctctggtttaaataagaaattaaccaaggtgtctattgtagtatagtggccataaaattcattctcttttaatttctttgcatcaattatcaatgcagaacgaatttcatcaatagctccctttattttctcaacgatttcctcgcttgaatgaggttcgctaacaggcaagatagttaaatctagtaactctattatctgacttttcataatgtcagaatccgtatacttattcaagtcttgtagaactttctgagattctgcaattgcatctgcccccaattcctttagatagtcaaggtactgttgaataaacttctcattatcctgtatatttatttctacatattgattaattatacgtaagtcttctctcttcaatatttgaatatgtttattgctggatagcaaataaaataaggccatttggtctaaatacttatcacattgaagtaattcctgaatataggaatctatctgtaatttaaacttttctttatccgtatcagaaataaacaaaaaggtaaatacgaaatatatcagtattagtaaattgagtctggttacagtatgactcacactttctctactttccaatagcgtcccaaaaatacttcccctatcaacaaaatctctaatttgatcataagtgctaactcgaacaattaattccctaaataatctagaataagcactaatgttagaggtatctctataaaagatttccgcccacacctcttctgtttttattttttcatggagcaaagtcaagagtttctttaagtgctgcgaatccaaggatgatcctggaaacacctcaagaaaagcatcgacaattttaaaaaaacgttctatatactctttggatagagagtctgctttctcacactcttcaataaactgtaacaactctttttctagctctgtattttccaattgtctaatacaggttaccacttgattagttgttttcgacgtatcaaaatatttcataactacctccatatctacatattcttcaactcaatgaccatatcgcgaatctgggctgccagttcaaagtcaagcacttctgcggcttcctgcatctgaccttccagtttcttgatcatggccttgcgttcatctttattaagagcattgaagtccacaacctcttccttgtcctgagtgacagccttggtcacgctaatcaggtcacggatctctttcttaatggtctgtggaataatgccatgctcttcattataagccatctggatttgacggcggcgggctgtttcttccatggccttccgcatggactcggtgaccttgtccgcatacataatcacatgaccttcagagttacgagccgctcgaccgattgtctggatgagcccccgttcattacggaggaagccctccttgtctgcgtctaagatagcgactagactaacttctggcacgtcaatcccttcacgaagcaggttaatccctatcaaaacatcaaagacacccaagcgaagatcacggataatctccgtacgctccaaggtcttgatgtccgagtgcatatacttgaccttgacgcccatttctttcaggtagtcggtcaagtcctctgccattttcttggtcagggtagtgataaaggttcgctcgcctttttcaacacgggcattgatttcacctaggaggtcgtccatttggcccatagttggacggacttccacttctggatccaaaagcccggtcggccggataatctgctcgacaacggtctctgtctgctccatttcatagtcacccggcgtcgcagatacatagacaatctggtggacatgactctcaaattcttccctgcgcagcggacgattatccaatgcactcggtagacggaaaccatagttaaccagcatctccttgcgtgagcggtcaccattgtacatccccttaatctgccccatggtcatgtggctctcgtcaatcataatcagatagtcctcagggaaaaagtccagcagggtataaggaggctccccctcacttcgcccgtccatgtgtcgtgaatagttctcaactccgttggtatagcccatctcccgaagcatctcgatatcgtagtcggttcgttgtttcaatcgctgagcttctaagagttttccttctgcctcaaagaccttgagttgctcttctagttccgcctgaatcttggcaatggccgtttccatgtggtcatcgttggtcacgaagtgggtggcagggaaaatggccaagtggtccacatcgcccaaaaccttgcctgtcaggctttcaatctcacgaatgcggtcgatttcatccccgaaaaactccacacgaaaggcatgttcgtcacgggaagctgggaaaatctccaccacatcgccacgcacacggaaccgtccccgttggaagtcgatgtcgttccgctcaaactggatatccaccaaggcattgagcaactgatcacgggaaatctcctgacctggtcgcaggctgaccacgctatctgaatattccttgggtgaacccaaaccgtagatacaagaaacagaagctaccacaatgacatcattgcgttctagcagagctgaggtcgcagagtgacggagtttgtcaatctcatcattgaccgaactatccttttcgatataggtatcgctagacggtacataagcttctggctggtagtaatcatagtaagacacgaagtattcgaccgcattttctggaaagaattccttgaactcactataaagctgaccagccaaggtcttgttgtgggcgatgaccaaggttggcttattgacacgggcgataacctggctcatggtataggtcttaccagtaccagtcgcccccatgagaatctgggctttttcgcccccctcgatgttatcaaccaaggtttcaatggcttggggctggtcaccagacggtgcatattttgacacaagtttaaattggttttcagtatttcgattgatcatactcctattttatcataagttcgactaatggagaaacattctaaaccattcacaactatgtccaaaatattaaattttctcacattttaatgactttgtatgtcagaaattctgacattataaaaacctcaattttgcattaattttcagaatatgatatactaggacagttattttataatagaaggagtatggaaatgaagaaaaaattactcatgttattggcaagcattctgccagtattctttatttttactggcattaaagctgacgatactattgatgtcgtatttgacaatgcttacgccccattcgagtttaaagactcagatcaaatttataaaggattagatgttgacatcatcaacgaagtagccaagcgctcaggttggaccatgaatcaaagcttcccaggatttgatgcagctgtcaacgctgtacaggctggatctgcggacgccctaatggcaggtacaactatcaccgaagcgcgtaagaaagtatttactttctcagacccttacttcgacaccaaaatcgttatcgctaccacaaaggcaaataccatctcttcatataaggaccttaaaggcaagactgtcggtgtcaaaaacggtactgcagcccaaaacttcctagaagaaaacaaagacaagtacggatacaacgtaaaaacttttgatactggcgatttgatgtataatagcctttctgctggtgctgttgatgctgtaatggacgacgaagcagttattcaatacgctatccaacaaggtcaagacctaagtattgacatcgaaggcgaagccatcggttcatttggtttctctgtaaaaaaaggtagccaatatgaatatcttgttgaagactttaacaaggctttagctgagatgaagaaagatggcacctacgaaataatcatgaacaaatggttgggagcttctaccacttctaccgaaagtacagattactcatctcgtttaagcttaacaggaaacgcatcagctaaagcaacacctgtcaaatcaagctacacaattgtggcagattcttcttttgctccatttgaataccaagatgaatcaggtaactatgtcgggattgacatggaattaatcaaggcaatcgctgaacaccaaggatttaccattactattcaaaaccctggtttcgacgctgcactaaatgctgttcaagctggacaagctgatgcagttattgccggtatgtctatcacagatgctcgtaaggaaatctttgacttctcaaacgcctactatacttcaaacatcctattagctgttaaaaatggtagtgacatcgcttcttacgaggacttaaaagggaaaactgttggggctaaaaatggtactgcttcatatagtttcttagaagaaaacaagtcaaaatatggttacaccctaaaagccttcgacgaagcttcaagtatgtatgacagtttaaactctggttctattgatgctcttatggatgacgaagcggttcttctatatgccatccaacaaggtcgcaactttgcaacaccaattcctggcgaaaaatcaggtgagtacggatttgccgttaaaaaaggtgccaacccagaattaattgaaatgtttaacaacggcttagctgccctagttgaatcaggcaagtatgatgaaatccttaataagtatttcaactcaactgaagaagcaagcacaacaacttcaactgttgatgagacaacgattgttggtcttttgaaaaacaactacggtcaattactctcaggtcttggtatcacaattggacttgcccttctatcatttgctattgcaattgtgatcggtattatcttcggtatgtttgctgtcagcccagttaaagcactccgtgttacttcatctgtttttgtagatgttgttcgtggtattccgctcatgattgtcgctgcattcatcttctggggtattccaaacttaatcgagtcgatgactggtcaacaatctccaatcaatgactttgtcgctggtacgatcgccctatccctcaactctggtgcctatattgccgagattgttcgtggcggtattcaggcagttccagctggtcagatggaagcatctcgcagtttaggtatttcctacggaacaaccatgcgtaagattatcctacctcaagctggtaaaattatgttgcctaactttatcaaccagtttgttattactctgaaagataccactatcatttctgcgattggtttggtcgaactcttccaagcgggtaaaatcattattgcacgtaactaccaatccttccgtatgtatgcaattcttgccatcatttacttggtagttatcacactcttgactcgcttagcacgcaaactcgaaaaaggaggcaaataatggctcaattaaaaatcaatgtccatgacttacacaagtcttatggtaaaaacgaggtcctcaaaggtattactgctaagttctatgaaggcgatgttgtttgtatcatcggtccttctggttcaggtaaatcgaccttccttcgtacaatgaacttacttgaaaccattacaagtggtcaagtaacagtcgatggatatgacttaaccgaccctaagacagatgttgacgccttccgttcaaatgtcggaatggtattccaacacttcaacctcttccctcatatgtctgtacttgacaatatcacatttgcgccaatcgaacacaaattgatggacaagtctgaagctgaaaaggtcggcatggaattattggaaaaagttggattggcagacaaacgcgacgctatgccagacagcctttcaggtggtcagaagcaacgtgttgctatcgctcgtgccctcgctatgaacccagacatcatgctcttcgacgaaccaacttctgcccttgaccctgaaatggttggcgatgtactcaacgttatgaaagacttggctgagcaaggtatgaccatgttaatcgtcacacacgagatgggctttgcccgcaaggttgctaatcgcgttatcttcactgatggcggtgagttccttgaagatggtacaccagagcaaatctttgataacccacaacatccacgtttacaagacttccttgataaggtcttgaacgtctaagctaaacgaaaagccttgacttgcatcaaggtttcagattgaagaaaaagtccattttggacgattttcttcaatcttttttctttatgttgaaaataaaaaactcttagaaacgccgaaatatcaatgtttctaagagtttaatgacttgctatctttcgcaaacttcttcaattttttatatttttaagagtttatctacgttctgaagctttgactttcgtcaagttttttttggtatctcaaaattaatttacaatatcatcttgtaggaccaacctttctttgtcttttcaacagcttcaaagccacatttctcaaacagtttacgggggcctgtattccagtcatatatttcttctacaggtatttcctcaagccccacttctcttgcacgttcaatcattcgctgtaataccttggttccaattccctttttccaataccgcttatctccaatggcaatggcaaaatcatctgcaaacagcgtcacatcaccaattgggataaactgattgtcttcaaaaatttcaataaagtaacattcgccatttttagacaaataatcatacatacgattgagcaagtcaagactataacgttcttgatcaccatcaatcagccagaccaattctagatcttggtgccattcaaaagaaaaatcatgctgaccatcataccgacgtaaacggacttgtttgtctatttctaaaatatctgcttgctcaattccagtgattgccatttcggatcctctctcatttacaataagttcattttaacatatatctctatcgaaatctatgaatattatagcacgctgattgacaagattctatcgatatgctatattaaaacaaataaagcatgcgaggtaaggagaaatggacaataacaagtaaactcaatttaagttctatacttatttagtagttttcttgcgtccatttttctgtttctctgttccatgaatagggtctttttgagcagatttcgacacactactaaataggtagtgtgttttttcttgtaaaggaggccttatgctactaaccactcatcacctatctctcgaccatcaaaaagatttgcgaaatctagttcaggacctaaacctcattgttaaccctggcgataaaatagctatcatcggcgaagaaggaaacggaaaatccagtctattactcaccttgatggattccactcttgtcgccgactacctgcttcaatcaggcagtattcaccgatattttcactcaccagtctatattccccaaagtcttccactggaaatagcagagctaaccctgaacgactacttcttcgctgacttggacagcgacattgattacagcctactctacctctatgctgaccagctccagtttgacagtgagcgatttgccagtcaacaattgattgaaagcctgtcaggtggtgaaaaactaaaaattcagttaatcaaatctctagcaactccatctgatattatttttctggatgagccgtccaatgacttggatttagataccttactttggcttgaaaactataccattactagtcctaaaaccatcctatttgtttctcacgatgaagactttcttagcagaacagctacaaaaatcattcatctagaatcggttaaaaagaaaacacttgcacagaccaaggttgaagaactagattaccaggattacgcattgagacgccagcaagcttatcagaagcaggtccagcaagctcggaacgaccaaaaagaatttgacaaagccatgaataagcacctacgtcaaaaatcacaggttcgtcacaccttgctcaacacccatgatgccacactaggacggctcattgctaagaaaatgaaaaatgttctctcacgtgaaaaacgctatgaaagaatgaaggaaaatcttacacaagttccttttcatgaagatgccatttccctcttcttctcagacatttcaccactaccagctagaaaacaagtgcttcacttagaaaacttccaattgaacgttgaagaacgacaattagttagcaatatccatttcaacataaatggacaagagaaaattggcatcattggacaaaatggaattggtaaatccagttttctaaagctaatctatcagaaactcaggcaccgagcagatataaacttgggatacatgccccagcgctattcagaagtccttgatgagtctaaaactccacttgattttttattagaaaatggcaatcgtgagcaggagcaacttatcttaacacatctagccagtctgcagtttacacgacaagaagttcatcacaagatctgtgaactttcggggggacaaaaagccaagttactcttgttaaaaatggttcttgatcaagccaattttctcttgttagatgaacccagtcgaaacttctctcccacttctcagccatatattcgtcaactatttgccgattatccaggtggtttggtatgcgtatcacacgacagacgctttttgaaagaagtttgtcaaagaatctatcgactaactgagaatggactggaagaactaggacagatataaaaaaggaaaatggcacacacgccaaatttccttttattatttattcataaagaatgaagccaagctattcgattcacaacctataatttatcaagagcaagttgcaaatcttcaatcaaatcattgatattttcaagaccaacagataggcggatttgatttggtgtgaccccagcagcaagtaaatcttccggagctaactgagcatgcgtggttgtagctggatgaactactagtgatttcgcatcggcaacgtttgctaaattagaaaagatttccaagccatcaataacctttcgggcttcttctgctccgccttttacttggaaagagaaaatagatccaacacctttaggcaggtatttatctgccaaagccttataaggactatctggaagtgatggataattgaccgactcaacattagggtgattgagcaagaaatcaacaatcttttcagcatttgacacatgacgctctacacggagagacaaggtttctaacccatgcaaaagcaagaaggcgttgaatggagaaagggctgcacctgtatcgcgaagtaattgtacacgaactgcaacaataaatgcagctacaccaatatcacgagtataactaatgttatgatagcttggatcttcttcaacaaattgcggaaacttaccagatgccgcccaatcaaacttaccgctatcgacaatcacaccgccaatggtcgtaccatgcccaccgataaacttggttgctgaatggacggcaatatcaacaccatgagaaaatacattaatcaaatatggggttgcgaaggtattatctgaaacaagtgggatgtggtaggtgtgtgcaatttctgccaatttttcaagatcaggaatattgataacaggatttcccaaggtttcaataaataccagttttgtattatctttaatcgcagcttctaccgcttcaaaatcatcaatatctacaaagcttgttgtaataccatagcgaggaagggtttctttgaataggttaaaagtcccaccatagagtgtcgttgccgccacaatgtgatcaccagcatgcgctaatgctagaatagtgtatgtgatggctgccattcctgaagaagtggccaaggcaccaataccaccttctaaagctgccacacgattttcaaaagtagagaccgtcggattagtgatacgagtatagatattccctgatttacgcaatgcaaataaatcttctgcttcttgagcatcttcaaaaacataggaagtggtttgatagatgggtactgcacgtgattttgaagcagaatcaacttcttgtccagcatggagttgaagggtttcaaatgaaaattctctagtcataaaggtactcctttggtctttttctgtattctacctcatttttaccatcttgactaatacttaaatattagagatatatatagttaacaactatagccataggatcagttattttagaaaaaataatattcattttccttgaataaaataaggacacgatttacaataagattatgaataccttaatagaatatatcggtccgattatcctcatagtactaataatctcttatagcatctatcgcagatgccatcctaataatatggacactaaacaagcgctcaaatgtccaaaatgtaagtcaataaaactgcaaacttacattccaacacaaaaaagatattctcgtaaagccggtatgattggtcatgcaatcaatggcatagagggagctatgtttgcaatgctctatgaagctgatcggacttattatcgttgtcaacattgcggttaccgattttctagaaaggagaatcgttttatttccaacatcgaataacctccctgatttttagagaattttgctattgaaaacgaagaattctcaccccttacaaatcccgttatatcaacatttacgaaaatgaaacttccatgaaaatggactaaaatcctctgatttggataaaatcgacaccaattaacaccataaaatagactagtcatcagtaggtcaaactaatttgacctactttatcttatagatggataatttattaatcaaattcaaaatgataggtcaagtattttataaatttatcgatataagaagacaaaaaaaactaatcaatacgagttattcttcaagaaaaaatcttttcaaaattatttctcttttaggaagttcgacttgttgctgattatctctatataaaagcattatataactcgatacaagccgtatatatggacttaatttctatagcctcaaaataatagtatagaataccaatgtctaatctttctgttgaaaagaccatctctttatctaagtgagccaagagtttgtcgcgaagcaatttgatttcatcaatatttttttgttctttatcaataccctcttgaatggtactcaaaattgataaaagagatctatctttggtactatgtctcaacttagatagaatcttaaaaataccatttttttctctgacatcaaaaattttagttataccgaagacaactctataaaataaagattcatatgttacatttcgtactatatcatatctaatagatgattgcactactctatcatgccactcatcgtttacaatttttactatttcaagtgcagcaattattgatccaagttcaagtatcatagtatgaaaatgaatcattattttagagtcatcatctggtaattcatcagcgaaattttttcctacaaaatcttttaaatcacaatcattcataagctaacacctatttaataaatcttcttacttttattcaaactgataattcattctgcttcaaaaatattttcgagattacaagcatatgtaatgtcctctctcactaagtatatcataccccataggaatacatctactacgatttttgtatcgctttatcatctcgtaattaagtcattgataaagttttctcaaaatacagctgaacaccctgcaacacttaatttaatttttcataatattaaattaagcaataaaccccactgacttattcagccagtggggtttttgagtgttttccgtagaatatttaaattacttaactatggtatttactcaataataatatcaaaatattttgtatcaacctcttttggagcgacgtaactaatatttcgtttggcattgaatatgtcagattcttccagtgatgtagagagtccgctccatggttctaatgcgataaagggactctgatttgtagttgaccaaatcactaaatatggaaaatcatcaaatgcaatcgaaagtttcttctgatgattttttgatttcaaggttacctttcgtgatgctaattgatccaatgttatggcatcatactcaaacagtttataggacaagtccaaggtcttctgattttccaagaatggccggcgatctcgcagatcaagtaagccagtttctggaaaacttctaggtactgtacaagattctactttttcaaattctaaataatagtcttcataactctcaccatccaacaagggacaattaaaacctgggtgacccccaataaagtaaggtagctttctatgtccctcaaggtttttcacccgatattcaattcgaattgttttgccaaatagtgagtagttaatagaaagttcaaattcaaaagggtaattttttacggtttcttcgtttgatgaaatagaaaattctaaagagttttcagtactttttacatttttgaacagcatttttctcacaagtccatgccttggaattgtgcctgtaaatgtcggtctttctgcaggttcatagatagcccaatcatttcgtaaacttccacaaatcggaaatagaactggtgcttgaccgctccaataggtcggttctccttgccaaagatattcgataccatccttgtctttaatagaaataatttgcccacctaattcagaaaattgtactgttaagttctcattttttaattcgagcatataaactgcctcccttatatgaaaacaaggatgctaacttgagctaggcatccttgtattagttttattcaataacctgtgtttccgctacttttttataccaataagcacttttctttggataacgttcttgggtctcaaagtcaacatagaacaatccatatcgtttctcgtatccatttgaccaagaaaatacatccatcaaggaccagatgaaataacctttaacattggcaccatctgagatagcatctgaaatcacttctaaatgctttttcacataatcaattcgaccatcgtcgtagactgtaccatctacaaattcatctttatagcctagaccattttcagtgatgtagattttcttatagtttggatagtcattttttacacgcatgatttgatcataaagaccttgtgggtagataatccaatcccaatccgttttcggaatatcgactggagattctctacgaccaactcccttgatttgatacttagaacttcccttttcacctttaccattatggataatttccgtttctccatcatgagctctcatccaatcactcatatagtaattgatgcccaagaagtcgttcaaatcttttgcggcatctaaggcagcgaagtcttcatcacgaaggtctaattccccaccatttactttcagaatatgtcgaacgccttcaagcgttttttcagaatagtaacccaagtatgtagcatcgaggataaatttattatgaataatatcttctagttccgctgcacgaacatcgtcaggattggttggatcataaggatatttcgttggcaatgcgtgtacaacaccaatttctccactataaccagcatccttgtaaagcttaacagccttggcatgtgaaaccatcatattgtggtgagattggaataccttagctaagtcatactgaatccctggtgggaacttcccaactagatattgcccatcaccaattggaccgatttcattaaaggttgtccagtaactaacttcagggaattctttgaagcaaaacgctgcgtaattgacgaagtgctcaatattttctcgatttagaaagtcaccattagaatgtagcgtttctggtgtatcaaaatggtgaagcgttacaaatggttctacgtgacgcttatggcattccgcaaataatttatggtaatactctactccctttggattcacttctccaaagcctgttgggaagatacgagaccacgcaattgaaatccgaatgccatttaccccaaactgttcacttagttctaaatcaactggataacgattataaaaatcagaagctggttccgcagtgtaccagtaattatcttctagatacttgtcccacgcaacacgaccttttccatctgtctttgtggcaccctctgcttgatatgcagcagttgctccaccaaatataaaatctttcggtaatgttttaaccatatgcctaccttcttctatcaaaaataaataaaggggtaggagttggagatgataactccctccccttttgattaagaacctgtattcacaagtgaagtgcttgtatatacttgtatataagagatagtttttcgctaatcaaggcgtttttttgagggaatactgactgtattttgaaaaaaactaacgatgagtagctgaaaaactagccttagatggaagtgctgaactgtgaatataggttctaaaactgttgtttgacaaagtcaagagcaccttgaccatctcgtgtgagtttaatgtattgagccccttcagttttggcaagtttaatacccaatgcatcggtttcttgtttaatgtcatcgtagtttgatgctacttgaggtgcaaggatgactaattgatactctggcaaaatctcacggtgcgccccatagcttcctgctgtagctgtaactggaacaccatattcttttgcagctttagttagagcgttggcaagtaatccacttgtaccaccccctgcacaaagtaccaaaacattagtttgttcagaaatttcggtttcgactgcagccttttcaagaatagcatccgccttggcagtattaaaattagctgccactttctctttcaagctattttcaactttccctgattgttcttcagcaagaatttgctcatcataaactttcaagaatggataatagataagtacatcgacaaataccaacaaaatagctagtgcaaaggcaagtggagcaaagtttgttcccattacaatccccaatggtcctggagttgtccatggcaagttaacgctgaaactgttcatttttagcgtatcaacaaagaatttgaaaatccatacgttagcaattggagctaagatgaatggaacaaagaatactgggttgagtacaagtggcgcaccgaacaagatcggttcgtttacaccaaagaaagttggaacaactgaagcacgtccaattgctttatttcgtttagacttagtcaaccacataaacatgaatggcacaaccaaggtagcacctgtaccacccatagtcacgataaacatttgagtacctgaagtcaggattttgtccgcatgttgaccggcttgtaaaagctggaagttggtttcaatattagcataagtaatggctgcaattgctggttccacaatagatggaccatgaatccctacaaaccagaacaaagcataggcaccaaagataattgtaataccaacataaccatctgcagctgtaaacagaggctcaaataatttcagaatcgcctcagcaacgtttgttccaaggaattgacgtgtcacaagatcaattccatacaagacaaagatagacaatgcatatggaatcacatctttaaatgcctgggatacattcggtggaacttcgtctggcatacgaatagtgacattgtttttcacacagaccttatagatattaaccgtaatgaaggctgctagaaaggctgtcaaaagtcccttagttcccatgtaaccattggcaaatccaccttcaataccatcagaagccagtaataagaaacctgaaattgaggcaatcatggttgaaatgaagttaatctgattggtttttggcaattgacggttaaacgcatctgttaaagattttgcggtcgttcctgcaactaagacagctacaatacccattgtataaccgtaaggtttcatgatagctgcaactgcttcatctgaccaagtaaaaccaaagatattaggaacaaaagccaccaatagaaagatacttgagaacaagataaccggcatggcagcaataaaaccatcacggatagcccttaaataagggtttctcgaaatcttttcaaagaaaggcttccctttctcaatgaattcaatcaatttattcattacttatcacctcgtttgtaaagttcaatcatatgactcatcatatctttcaataacaacgttgtcatgagatggtcttgaccatgcatgagcgtcacactaaaggctaaatcctcaccagccgcttctttctgcaacaaacttgtctgagcatggtgggcttcaacaatacaagcattggccgcttcaactagttcttctgcttttgcataatcacctttttgagcagcagccagtgcctccatcaaacgagaacgagcatcaccagcgaatgcaacaatctcaaaacctaataacgtaatttcttctctgttcataatatgaacctccttttaaaattgaattgatttacaataaccgttgaatatgtaacacaatatagaacctttcactatcatttactggctcatcaaccaatgatgtaatcatctcaaaaatctgacttccaacctgatgggctcttggattctggagcttgatgtactgttccaaactagcaatcgattcatttgactgatgggatctatctaagtaattcagaaaataggacaaatgaatcataaagcgatcataaaaattgctattttcttttgagcgtctaatcccattatctatcaaaatttgttcaacctcagcaataattttcttactgatatcatgttcttcacttgtgggatgaattgtttcaccttttgcattgattaagtgaagtgcaattttaccaatctcatcatttggaaaatcatttagcaacttttcacgaaacatagctaaggcttcacgcgccattttatattccaatggatattcggctgaaatattgggtagcctactttcttgataggtattctttaaaaccgcctgatatgcacaatagatatgatctgtcagtgtcacatatagatattcttgtacagggtaatgataagtttctactagatgattaataaccgtgtaggttgccgaaataaaatctaatggaatatcttttaataaggttagaaaattttctttggcttcatcattttttagcgaaaagatattttctatcttgtccttaataattaaatcccctttcttcttttgaaaggttatacctaatcccatcacgactgcctgttccccatgttcatttttcaccagggcagcgttattatttagtgactgtataatcctaaacatatatccctcctatatttttaagcaaaaaaagactacaaacaaaccgagaatatcctactctcaaatccatttgtagtcttgcctaatcgaattagttacaatccactctattcttgctgatgagattattatagcatattctcagaaaatgtaaaccctttcttttaagaaaatggttattttttcaattatttttctagccaagaagttgctgtttgagacaagactacatcaagtccctcgatattttcacgaccaacagttcgtaaccattcacgcgcagcttcttcaccatgttcaatatagactggcacaacacccgcccatgttgcacgaccacaaagaacaccgttaaatttagcacctgcttcatgtgcaaacactagtgtatcttggaagagttttgcagaaacacctgcacttagataaatataaggcaaatgagttgatgcttcttgttgacggaaatattcggctgcttcttcttttgtataaacgacttcccctgttccaaagccttctacaaaattcatgttcacaggtacttctaccttgagaacatccactccaaatcgttcgtccgaaaataccttcatagcctcatttacttttcgaggtttgacttttgcaaattccacactggcattgtcttcaatcgtttcatcgtagctcaaaatttccaaaaagaatggcaaaccttctgcctgacattctgaacctaagcgttcaatataggcatgtttttgaagattgacgtatggatccccatcaacgtcatagtagagtagaaacttaatcgcatctgccccttcttcttttagtcgttttacagaccactctactaggcaatctggtaatcgactagtagagctggtatcatagccagttttttcataagctaaaagtagaccacattgttcatcgcgggcgcgcgatgctggcaaaccaaattcagggtctaacagaattgaggaagaaaactgtgttaattcttctgaaactagtttctttagttcttccatctgctccacagtaggttcttctgtctgatgttttgccatcattcttttcagggctccacgttggtcaaaagctaaagctgaaataatacctgcttcattgcttactttttccatgtattttcttttatctgctgttactaccatattatacctcttcaacttcgatttgagaatacaacgattctgcattttctaaattgacgtaacctgtctgttcttcctgagcatttaacatgcctaaaacattagcattttttaataattctgcttcaggtaaagcatgtaccaaacctgctgcaatacctgcaacagttgaatctcctgatcctactggattgacaactttgatttttggaattctgacacgatagaacttgtcattgtgcttggcaaaagccccctttgctcctaatgagacgactatccaatcaattccttggaaaagttgatcagacaaaactgatttcaactcttgaatatcatcagtaacttctttaccaatcagttgtgataactcttctgtattcggcttaataactgtcggcttctgctggctttctaaaacgtttttcagcgcctcaccagaacaatccaaaacaacagctacaccgtattttttacaaagttctacaatctcaacataataattgctagcaagtcccttaggcaaacttcctgaaatgacaactacatctacattgttcaggacgatttcaaggtgttctataaaattcaaggcttcatgttcttgaataattgggccttgttctaaaatctccgtctgtttgccatcatgaagaatcgcaatgcaattacgtgtttcgctcccaatttccacaaaggaatttttaatatcatttcgagtgagttgtttctttacataacttccaatctcaccaccaataaaaccagtagccactatatcttcaccaatttgtttcaaaactcgtgtgacattgagccccttgcctccagctgttttttgaacttttttctactcgattgaccgtatccaaatgaaaggtatccaagtgataggcaatatcaaccgacggatttaaagtgattgtcaaaatcatgtgagcctcctagtcgtggtattctccacgatcccacttttcaagaaattctgtaaagaactctggattagcttgctcttgattgagcgtttcaactgcagcaatcttttcaattaagcgtttgttttcttcagttggtttgtattctgctttaataaaggcttcaatgatgtcgcacatgagcagctcgcccgtaatctttcctccaaaaccaatgacgttggcatttaactcttcttttgcatagagtgcagaggtcatatcacgaaccagggctgatcggacgccaggtaccttgtttacagcattgttgattccaacacctgttccacaaatacaaattcccaaatctgcttgcccgctcacaactgcttcaccaacttttttaccaaagattgggtaatgagtacgaacattgtcataagtcccaaagtccaatacttcatagccttgatttttcaaataatctaccacagcgattttttcataggttacaatgtggtcacaaccgattgcaattttcatctcttattctcctttgtttacaaccattaacacattttatttagcatatcgacacgaatttggtgacggccaccatcatactcaccttcaacaaatcctttaacgatatttttagcaattccttctcctacaatctcactaccgattgtaataatacgcgaattgttgtgtcctcttgtcatataggcagagcgttcgtctgaaacttctgcaacgatcatgcctttgactttagttgcggtcataaatggaccaacgccataagcatcaatcacaatgccaagatttccttcctgttgattaacttctgcaactactgccaaagttgtatcaacaaaatcacttccatcactgacatctttaaagtcatatgatttttctagcaaataatctttaataacgtcttttagttttgagcccgctggatcagcaccgataatgattgtcataacttatctcctaacaaaaatagaaagttgtagccatatttggcagaaaatctttgttttgcaaaacttagaaaagcgttttcgctttttatgtttaaattatacaaccaaacaaacataaagtcaacatattttattttatttttgtttgtttttttcgtatacaaacaaaaaaccaacatttctctgttggttttgataactttatgattttgtagaaataatttcaatgtgattacttaataattggtaattttcatcctttgcattcatatctgtcactagagcagttgcatcattcaaatcacaaaaagaagtaaaatcatcttttccaattttcgtggcatccagcagtagatatttttctaaagaatgtttaatggcaatattttgcgtataggcttccgctagggtagaggtcatgacatcagttcccttaagtccgttacctgaaaagaaaatcttgctgaatcgcattttttctaaacttgtattggtaatttctcctacaaaagattctgtcacttgccgatattctcctccaaggagaaagacttgaaaatcctctgtcttcttttgtgataggatagtaaaaacaggcatacaatttgtgatgacagttaggcgaagatttttaatggcctcagccagaaaggccactgttgttcctggacctaaaaataccgtgtctccatcttctatcagttgtgcagccctttccgctatctcttgcttggcttccttattctgaatgtgtttctcagaatgggaatattctcgatattgaaaagccttattacttctagcaccgccatgaatttttgttaagacaccttgctcttccaattcaatgaaatcacgtcgaacagtcatatcagtaacatttagcaattctactatctcagaaattcgaactgtgccttttttgtttaccaatcgtgtaatttcttctagtcgttctcgtttattcatgtttaatcctttgttgtttttttacattatatcaaaaataaacaagaatatgttggaattttgaacattattttaaatgataattacaactttattatgcgagcaatcttcgcgagcaggttttgcgcagttcgcaaaacatcggttcgttagaaccgactgcaaggaaaaaagaaagcattgagttaatccatactcatcgtacactccataactattcaggttcatagcattgttttgcaaaatgggtttcaattaacatttcgccagaacagttaatggcattaggtaatgttgaaaaagatacggaaggttggatagaacttatcaatcaatacttacaatattgtatagagattggtttaagtccatatacacaagctacctacaaagtagcattggccaaagttctcggagtttcctcaactaatttcatcgctacacaaccacgtactcgtgcgaatcgtatgaacaatcgtgtattacataaagactatcgtttatccaacaaaaataacgactactggcataaagtagttacctcgacaggcttacgcaaaagtgaattaatccacgtcactggcgatgctctgcaacgcggccgtgatggccgttggtatttaaatttagccggccataagcatcacacaaaaggacgcagagatcgctggtctccaatcatggccactagtcaagaggaggaagagtggttagtcgctattttccaacgagcaggaaaaaagaaagtctttcatgttcccaaagatttaatcctcgacgattttgatggaaagaaagttccaacagcattaaagtcacacaaatatcctgcagagtatgcagagcgtgtttatcgcagtgtagcacgcgaaatttccaagattagaaatcgtaaagaaattatccatctgcgtaaagagttagttggcatctcgctcgacagaaaagcttgtaaaattgtaacaaaggctctgggacacaatagaccagaggaatttccacattcctatgcttatattttattgaaacgttaggaaacattgtacatttttcaaaaatcaagcctcgatttgttgcacatgtggcataatacttatatctagaaaatgaaaggaattttatatgttacctcaaaataattctcctcttctgttaaatagacaacaagtagcggaactacttggaatagatcctaaatcatttggtaagtacattagaagtcacccagactttcaatgctttatggtgggaaaacaagagcgctatttgaagtcaaaactggttaaatttattgaaagccactgcgattgacggataatgattgataaaattagatttttcatatatcctatatgtgactagtctattttatcaatcattttttatagaaaggctgataaaatgtcaacaataacaaaacgtggtaactcttaccgtgcaactgtatcactttataagaaaggagaatataaacgagaaactaaaacctttagcaacagaaaagatgctgagctttggacattagaaatggaacttgaaaaaggtcgtggcaaaaacattgccgaacgctccaccctatttcctgatttttatagaaattgggtccatacggtcaagaaaactgacgttcgcgaagccacctttattaactataaacgaactctcgtaatagttgatgacctttttgatggtattcaacttaaacaccttgacgatctcgtcatgcaaaagaaaatcgaccaatacgctgaaacccactctaaaaaaacagtaaaagaacttgttcttaaaatccatggttcattaaaatatgcgtatgctcgtggtttgattagtaatgattttggtcatcttttgaaatcaaaaggacaagaacaacctaaacgaaatataccactatctatcacagaatttaaaaaactcagacaatactgcctaagtcatactgaggatgaatttaatgttcttgttgctctcgcccttgagacaggagcaaggcgcggagaacttttaggaattaaaaaagaagatatttttgaatatggtatcaaaattcttcgatcaattagtccaactaatgacgatgcccagcttaaaaccaaatattctaagcgtgatatttccatcaacgaagatgtttatcaagctgtgacaaagcttgcacaaataaaagaaggctatatctttgattgaaatggattcaagcaagctagtcaacttcaaaagctgttaaaacagttgggattaacaaaaacgacatttcatggacttcgtgacacgcatgcctcatttctcttttcaaaagatattagcctagactatatttctcgtcgtctaggtcataactctatcttaacaacacaacagtattatctagaattgatgccagaaaaaagacaccagcaagatgctgaggccttaaatttattgaattcattaagcgagtaaacatttgaaccaatttgaaccaaaaagtcggcacaaatgttgtcgccataacgtttggattaacgttttgagctataattcaaaaacattcactccaattttattagctgaaatataaccctataaacgcatcattagacttctttctttaagattctaagctgatgcgctttttatttatctgttactccaatcagcatgagatgttttcctacaactgtatcggttaactgactagcttaaaaattcctgtccaatttagaaatgcctttcgacgcatttgttcgatttcacagcgaaataatcctgctaaggttgctctatttaaaacaatatcattcttacgagaaaggctagttactttatttacaagcgtatcgacttcttcaccatctcgaattcccatatcccataactcttgaagtactgattttttatacattttctcatattctgccataccttgtagagtccagtaacgttcattattctcaacttctaaccattgccacacaatttctgtatcagctacattaggtttttcatgctgacaggatagacataggaccatctgattagccaggctcgtatccttgctccatttgcttgatacaatctgacacatatttacaccatgagaacttttacatctccagcattttccttcgagcaattcattagcgctcaaaattcctctttctatcaaggtatcattccaatactctgcaactttcgatacttcagctttcttattcaacaaattaaacattttcattctcctactataattacttttctaatatctgtgtccgaaccatactagcctacaacattgctaactcaactacacaagaataatgactcaaatcaagattttccaacaaacgataagatacaaataacttcggttgcaatcatgtgagaggttttgaccatattaccgcttctgactggaattgtttgagtgcctgaaaataaatctgattgactgtaagataggctctaccatttagtaaatatgcgtaatcttgtattaaatctctacaaaataaagctacccaaatagctgcggtcttctcaaaatcagtatcgtaatcggctaataagtccagcgtaatcagacttccttttccaaaatccttcgatttctgatttcgcaatttttcagtatttatcggagtcgccaaaccaaaatgattagcataggtttcccactctttataaatatcattccaagaaatctctgtaatccttttcatttgcgactcctatttttctttttgtgagattatcataacaccgttttgattttttgttaaacacgttaaacaaaatttgcaaaaaatattttttaatggtataattagttaaacagataaggagacaatcatgattttaggtgatattttaaaagaataccgaagcaagaataaattatcaatggataaattcgctgaattatctggtttaacaaaaggttatatttctatgttggaaaagaaccagcatcccaaaaccaaaaaagctctcctgccaacgatggatacgctagaaaaagtcgctaagggcatggctatatcggttggtgagctaatcgagcaactagattccaatcaggatatagctttaacgattactccttcccaatttaaactctttcaacagcctattcatccagaggttctaaccttggacaatgaactaaaaggtgatttccatgcacaatggttaacttttggtcaagaacagttagcagctatgcaaactgcctcagttactccttctgcttctattcttcacttggatgactatcgggagcgaatcgaattacctgttcctggtaaggtttctgccggtacaggttactggcaggatacagatatgaacaatcttgtatcattctataacgatgagattccagataaccaatcttatgatacaatcgctcaggttgtgggagattctatggctccgcatatcgaggatggagactatctcttcattcgcctaactcctcatattcctctaaatacgattggaattttttcagtcaatggggaaaattttgttaaaaagttcaaaggtgactatttgcaatcactcaattctgactatgatgatatctattttagcccagaagacgatattcgacctattggtcaagttgtagatatttatagtccagattgatttttaagcctagttaatcactagttatatatgctacattcatccatctagttttggaaagtctgtccgtatagctggcgttttttcctactgaaaacaaattgaaaagcacagtaaaaggaggctatgacagcctcctttttatatgtcaaattggaaaagtccattaccagatagttatttgacaacaagttaatgattaaataattattctgctacccttatgtctttgattgtcctcttactatttgtctaaagtgtggagattgcttattatgatgaaaatcgctagaggtttttgtgattttctaaggttatgttcaaaagttacaacatcttgaacacatagtagttacgacacgaataatcttagcctacttctgattgaaccgggtagcaaggctaaataatgagttaatgctatgcatttgacaatggatatcacaaatagatataaaacagggataacggacttttcccctactagcatccctctctttttattagagaaagatggctaatagtatatacacttctacgaacgctaaagaactcctttcagcaattcagatggcgttcaacatcttaactaactatttccttttttcaattagattataccactattataaaacgctttcaaataattatgtgctccaaagtcaacttttttgcttttctttttccttgataaagttttcccacattttttgttgcggcttagcaaatgggtaggtaggaaaatcttctacagaaacccatttcaattcttttgattctggaaggttaagtgtttctgccacaccttctaccatttctatctgccatttgcggtgactaaaaatgtgctggacgatgccaaattcttgctcttgccaatcaacagtcagaccataaagttccgtaaagctctgccgaatatctggctgaacaacttcttctgcaacttcaaagagagagacttgtttgtcaacgattgctcctttttccaaaagcggaaaagaccagaaacctgatagaagacctgcttcattatttttttccaataaaaattgattgtctttattcctgatgagaaatccctggtaggccacgggaatcggctttttctttggtgctttgattggatacttatccattgtaccgtttaagtaggctgcgctaaaggctttgactgggctgtcctggggacgtggattaactggcgattcaatatccgaccctagatccattagagcttggttgaaatcgcccggtcgctctgaatcaatcaatagctccatcatcgcttggaaaatcttgcgattggcaggaagaccaatgtcataatcaacctcaaacaagcggctgagaacccgcatcacattgccatctaccgctggttctggcaaattaaaagcaatactggaaattgctccagcagtataaggaccaatgccctttaggcttgaaatggctgcatgcgtggtcggaaattgcccatcaaaatcttctaccatttgctgagccgccttttgcatattccgcacgcgcgaataatagcccaatccctcccagagtttgagaatgacctcctctggtgcttgtgctaaatcactaatcgtaggcaagtgatggagaaaacgttcataataaggaatgaccgtgtctactcttgtctgttgaagcatgatttcagaaacccatatagcatacggatccttggtccgtctccaaggcaagtcacgtttattggcatcataccaatctaagagtgctttgcgaaaagcttgaatcttttcctccggccacatttcgattccatattctttcaaatttaacatacatctagtataacacaaagaaagggagccagcttttgccaactcccttatatcgtttataatcaaaatcaaactagctccaaaggtttggggaacctttggaggttggaaatagagcgaacgaatttgtttttctaaatctagccaagactgtctgcttttgatgttcgaagagttttattctacttttcctgttacaaacatggtaaaacttgctgaagcaagtagctgtttatcttggttttctatcttaacttcgacgacctttgttctacttccatcatgtgtgcaagagcctattactgataaggtatcaccaagtttagctgccttcatataatgaatattggactgtagggtgacagaataagaaccacttgctaccgttgtcagacctgcaactgaatctgccaatgtgaaaagaaagcctccatgtgccataccgtatggattgagagatttttccgtcacctttgtggtcattagcacctctttctcattgagcattgtagcttgatagtcatctaaaaccgtaatcggttgtaagtttaatttatctaacactttcatcctcctctgtctgctgacttgtttgcatttgataataaacgccttgttcagccatcaacgcttcatgattcccttgttcaacaatttttccatccaccatgaccaaaatcaagtcagctgattgaatggttgataggcgatgagcaataataaaactggtccgtccttccatcaatttggcaaatgcttcctgtactaaaatttctgtccgtgtatcaatagaggaagtcgcctcatctaaaatcaggattttaggtatcttgacaaagacacgcgcaatagacaaaagctgacgttgtccctgggataagccttctcctccatctgccaaaactgtatcgtagccctgcggaagctgacgaataaagaagtctgcattagctgccttagccgcctcaatgaccaattcccgcgtggcatttggatagccataggcaatattatcatgaatggtaccagatttgatccatgtctcctgtaaaaccatcccaatctgtctgcgaagatcctcacgactatactggctaatcggaaccccatctaagacaatctgaccagccgtcacatcgtagaagcgcataagaaggttaatcatggttgatttgccagcaccagtaggtccaacaatggctactttttgtccagctttgacagcaatgtccaaatgttctatcagagaacgttcagggctatatgagaaagacacattgtcaaaggaaatagctcccttcaactcctctgaatcaattttccgctcagcctggtcgtcaatgctatctagagccaagatagcaaacagcctgtctgcacaagctaaggcgctctgcaattccgataggaccgaggaaatatcattaaaaggcttgctgtactgactagcataattgaggaaggttgtcagggatcccactgtaaaatttcctgccataattcttagcgctccaagtcctgcaagtaaggcataaataatagcattgacaaagcgagtacttggattgaccgttgaagaggcaaagatagcctgttgggaataggtcgcatactggtcattcacaacttgaaaaccttgcgtaaattgctcttgagcattgaaagattgaaccagtgtcaattgactgatggactcttccaaaagctgagattgcctcccacgtgcctgagtctgttgcctataataaccataggatttcttagcgatatagcgtgccacaagcagagaaactggagtcagggcaacaacaaccaacatcatcgtcaagtcaagcctagccatagtgaaaatggttaggaaaatggtcgagataccaatgaaaaattgattgaaaatcatcaagagaccatttgttaattgctcgctatcacttgaaaaacgagccaccaagtcaccgactgattgacgatcaagataagataagggcatctggtgcagcttcacatagacctgttcacgcaagtcggccaccattccgtaaaccaagcgattggttaccaaaggtaagtaccattgcaccagtgtattaagcaagataaccatcaccattttgcctaagataccgagcaagacctgaccatttgctatcaatactgcatcaactgcctgaccaatcaagataggcagataaactgtcagaaggacttgcaccaaagttcccaccaacatcaaggacattcgaaggggctggtgtagaaccaatctgaccagttccttaaaactagattgtctcatagctatcctcctctccttgttgttgcgattggtgaatttcttgataaatagcagagcttctcagcaagtcctcatggcgaccaagtccaacttgacgcccttgttccaagaccaaaatctgatcagctgtccgtaaactattggttctttgtgacaccatgattaagttctgacctggtaattcctggcgaatagcagctaataatcgactctccgtcaaataatccagagcagatgttgcatcatctaagattaaaatcggtgctttctgtaaaatagcgcgtgcaatggtcaaacgttgacgctgtccactagaaaaattcttcccaaaggcttcgacagggctatccaaaccacctttatcctctatgaaagatttagcctgtgcaatttctaaagcagaccataggtcactatcagatatttcttccaatcctaaagataaattagaacgaatagttccagcaaaaagctgggcctgttgcggaacgatggcaattcgctgccgccactcttttaaattcttaggactttttccatcaatgaagagagagagctgatttgttggcactgaatagagtgcctgcaataaatctactagggtggacttacctgacccagttcccccgataattcccataaactgttccttacgtaagtcaaaagtaatgtcagacagggactcctcagcagattttggataagaaaaggaaagatgacgcacagaaaagatgatttccttatcctcactaaccacttttggcaaactagactctacatcctcagatgtttggtcaaacacctcttgaatacgttgcgctgaaatataggtctggttgagagtagacacgaccataatcatcttgaccaattcgactaaaatttgaagaaggtagttgataagagcgaccaacatcccctgttccaacaaattgtgtgaaatggctatatttccttgccagatgagaatgagtaaggtgctgttgaccaccaaaaatgtcaatggcgataaaagactagaccaaaaaccagcctgcaactgttgcttcttataaatctgatttatgccttgaaaagccttaatttcccgctctctttgtccatatgcacgaatcactcgccaaccagtcacggtctcacgtacctgccccaccaaaccatctaattcttttcgcatcgattgataaatacggctggtcataacagaaatgactgtcactataaaaatcaataggataatcattcctagaaaataggcagatagacttgggctaatatagaatgccatgatgagcgaaccaaatacgacaattggagcacgtaaaaacaaacgaagaaaagtattaatacccgtttgaatttgtaaagtgtcgctggtcaatcgtgtcagcaaactggatgaggaaagaatatctcggctagacttgggaagggaaagaaccttctgatacaagtcattcgtcagctctttagtcactccaactgctgctttagctgaataatattgcgctattagtgaaacaataattccaatacatgctataccaaccagtaaaaaaagcatagcaaccaggtttccctggctgccatttggaataattgtatcaacgatataggcgataattaatggtaccaaaagctcaaaacaagcttccaatagtttaaaaactggacctaatatggattccttaatatagtccttaaaatatcgtgataaaaatttcatattaacggtgctccaaagcctgaaccgcagtaatcaaggtcaagttgtaaacatcatcagggttacaaccacgagacaagtcgtttacaggctgattcaaaccttgtaaaacaggacctaccgctgcaaatccacccatacgttcggcaattttataaccaatattcccagctgagatacctgggaagataaatacagtcgcttgaccagcaacactcgaacctggtgcttttaatttacctgtagcagggacaaaggcagcatcaaattgcaattcaccgtccaaatccaactccggacgcaatttttgagcaattttagttgcttcaaccaccttatcaactttaggacctgagccagatccttttgttgaatagctgagcattgcaacttttggatcaataccaaacattttagcagtacgtgctgagttgatagcgatttctgccaaggtttgagcatctggatcaatgttgatagcacagtcaccaaaaatataacgctcttcaccttttaccatcaagaaggcacctgatgttttcgatacacctggctctgttttaatgatttgaagagctggacgaactgttgaagcagttgaatgaatcgcaccagataccataccttctactacgcccatatataccaacataacaccaaagtagttcacatctttcaacaactcatgtgcctgctcttctgataccttacctttacggcgctctaccaaagcagctaccatctcatcatatctatcataatgagctgggtcaataatttcaaaaccttctgtaatcccttcaatgtcaaggtaaatcttaatacgatctgggtttccaagcaagacgggtactacatccgactcatttaccaaacgttttgtcgcctgcaagatacgtggttcttcaccttctggcaatacgatacgtacttttttaccctctagctttgtagctaattgctcaaaaattttcatgaacaaactccttaaatttatttacttattaactgattgatgacagcctgaaaatcctcaggaagcggtgcttccaaatcaatcctttcggctgaaaaaggattgtcgaaggccaaattatgacaatgcaaggcttgacgttctatcccacattccaaacttccaccatacatatcatctcctaacaatggaaatccaatgtgagaaaaatgaacacgaatctgatgagtccgcccagtatgtagttgaatatctactaaatgaatatctccccacgattgcacaacacgataggaagtatgagcatattttccattctttgtcacacaacgggtaatgatgctgtcttctggacgaccgataggggcaataatatcccctgtctcttctagctgcccattccccttcaccaaagcataataacgtttatgaataagcttggcctgtaactgcttatcgagtcgtgcatgggcatagccgtgcttggcaaacagcatgacgcctgatgtatccctatccagacgagtcacaatatgaacctgcttattctcataattctgctcaataagataaccttttacaaaatttgcgattgtggatgaatgcaaagcagaaggaatggaggcgtagccaaccggcttatttatcgccagaaaatgatcatcttcatagacaatatccaacggaaagaaaatcggttttaaactaccagtcaaatcctcttcagcaggtatgtcaattgtaaccctatctccaatatctagcaagtaagttgcattttgctcaatatcgttgacccaaatattgccacctgtgtacttaattttggccaacaaaccttttgaaacaccatgttttttcaaaaaagtttttattttagtatgctggtcagcaatgaattcaaaccgcattactccacctctccaataaaggcgtccttaacccgattccaaaaactagtatgactcggtgttgcaacaaaatgaatcttactattgtctatctgatactctatactttcaatactatcatagacaaaagtcttattgtctaccgcaatcgagtaacggtcactatgctttggttcaatcacaatcttgtcttttttagggacaacaacggatgaacccaaggtgcggtaaacacgattgttcaaacttgccacttctgcaatctgcaatgcctcgattgttggatgtaaaacagcaccacctaatgacttgttataggctgttgagcctgtcggcgttgaaaccgaaattccatcccctctaaagcgttcgaagggcacattgttaataataatatctgcgaccatggtcttagaaagacgttttactgtcgcctcatttaaggcacgcgcctcgacaatgcgaccatctgtcatcttgatcttaacatttaaaatcggatacgatactctagcacctgtatcaagcttaagattttcaatcagcttgtccacttcaaaatcgcgataatctgtataaaaccccaaatgacccgtgtgaattcctacaaaacgtacacgatcaatcaacttttcatatttgtgaaaagcagataaaagcatcccatctccaccgatagaaatgacaatatctggatttttaggagtcaaaataaaatttgcttcttttaactttgtccataattctttggacaccgcttcactcttaggatttcgactagcgagcagagcgattttttttctacctgtattcttcatctgtatcatcactgttgcccacaccgtcattcagtttgcgataggcaggatcaaataaggcctgcgcttcttgaatgtcgttgcggatttttcgcatatcctcatctaattcataagcaatttttgctgtaacttccaagcgtttcttgatttcttctggaaaatttcccttatatttataattcagagaatgttcaattgtagcccagaaattcatggaaagggttcgaatctggatttctgccagaaccgtctcgttgccatttatagtatccacaggatactcaatcaccacatgatatgaacggtagccagaggctttcatattattgatataatcccgttcatgcacaatttgcatatccttgcgtttccgcaaaatagctaatacttcttcaatgtcgtccacaaattgaaccataatccgaagaccggcaatatcttgcatatcttgagcaagattttccaatttaatatgtcgcagagccattttttctttaatggattcaatcggttttacccgtcctgtgacaaactcaattggagaatgccgattagccttgcgatactgcttgcgaatcccccgcagtttgattttcaattcaccaactgtctgaatataggggtctaaaaattcttcccagttaaagtccatacggcccctttcttgtcaaaacttttaaattgtattagaataacacaaagactaatctattataacacattgaaagggtttactgcatgaaaaaccaccttgaaattgagtataaaaccttactgaccaaatccgaatacaaacgcctgcttactgacttttcagatgtgagcccaattcttcaaacaaaccactacattgataccccagacctagatatgaagaatcaccgcttttcactccgtattcgtacatttgaggactcagcagaactaaccttaaaaattccacaagaagtcggcaatcaagaatataaccaagttctagacatccaaactgctcatgatttactggaaaattttcaactaccagcaggacaaatttctgacattatttctgcaaccgaaattccacttgataaacttgctgtctggggaatcctcacgacaaaacgctatgagaaacagacatctataggccttatggccctcgatgaaaatgattatgtgggacaaaaagattacgaattagaagtcgaagtgaccgatgcagatgcagggaaaattctttttgatgaattccttaagaagaaatcaattcaattcaaatatgctagtagtaaggtcgcacgaactgctgcccacatgaaataactataaaaaatcagccaactaaggttgattttttagtttcactactgaaaatttttcatttttttgatagaatagaactatctatcgtaaaaaatacttttatgtcatcataaaagctcagtgtgtaaaaggagttactttaaaatggtacaaccactcggtgaacataacattaaattattctcactcaatagcaaccgtgatattgctgaaaaaattgctgattctgctggaattcctcttggaaagctgtcttctcgtcagttttctgatggtgagattcaaattaacattgaagaatctgtacgtggcgtagacgtctacattatccaatcaacaagctatccggtaaataatcacttgtgggaattattgattatgatcgatgcttgtaaacgtgctagtgccaacactattacagctgtcatcccttatttcggctatgctcgtcaagaccgtaccgcttctccacgcgaaccaattacagctaaattagttgcaaatatgctggttaaagctggtgtcgaccgtgtattgactcttgatttgcacgcttcacaaattcaaggtttctttgatattccagtagacaatctccttacagaaccactttttgcagcctactacatggaaaaaggactctgcggagaagatgtcgtcattgtgagtcctaaaaattctggtatcaaacgcgcgcgtaatatcgctgaatttctaaatgcaccgattgcgattatcgactacgctcaagatgattctgagcgttctgaaggctatattatcggtgatgttgcaggtgaaaaagctattttggtggacgatattctcaatactggtcgcactttctcacaagcttcaaaaattgtccaagaaggtggtgctactgaaatttatgcagttgccagccatggtctctttgcaggaactgcagcccaactcttagatgaagcaccaatcaaagaaatattagttaccgattctgttgcaagcaaagaacagcatcctaaaaatatcgccttcctaacagctagtgacttgattgcagatgccatccaccgcatccaagaacatcagccactcagcccacttttcaaatttactagtcctgaaaaagaaaactaggagtaactctttgatttatttagataatgcagcaaccactgctctatctcctactgcactccaacggatgatggaagtggctcaagaaaattatggaaacccctccagtattcatcaaagcggtcggaaagccaatcaatgtcttagacaaagtcgtcaagagattgctcagattctctccgcctctcccgaacaaattattttcacatctggaggctccgaagctgatactttagctattcaaggctatgcacttgcgcatcaatccaaaggaaaacacctgattactacggctatcgaacaccatgctgtcctccataccatgcagtatctagaggatcggtttgggttcgaggtaacctatatccaaccagtcaatcaagtaatcaccgctcaacaaattctggatgcccttcggccagatactattttagtcagcgtcatgtttgctaacaatgagaccggtcagctacttcccatcaaggaaattggagagctcctagccgatcatcaggccgtctttcatgtagatgctgtccaagcaattggaaaaattgcaatttctccctctgactacggaattgacttgctcgcggcttctgcccataaattccatggtccaaaggggatgggattcctgtatagtaaagttcataaatttgattccttgatccacggcggaaagcaggaacagcaacatcgagcaggtactgagaatctccctgctattgctgctatggcgactgccctaacagaacaatatgagtccttagatacgcatcatcaacatgtcagtgaactgcgacaacatattatcgagggattgtctggcttagactattatctcaatcaggctggacctcatctccctcatgtccttaatatcggttttcttggtaaacttaatgaacaactccttatgcaactagatttggcaggtattgctgtttctagcggttctgcatgtacggcaggtgttgtccaaaatagccatgttttagaagctatgtatggaaaagactcccatcgtctgaaagaatccattcgtatcagcctatctgaaatcaatacaaaagaagagatagatactcttatcatcgaactaaagaaaatacttggaggttaaaatggcattccaacaatcagttaccttaaaagattgtaattttacttatcacattagccctgctatcaaaaaatatacactccgtgataacacctttgaacaaaccaaagcaggtcactatcagcttacacgtcttctggaagaaattccaaattcaaaccaaggattcctcttgaaaattattatcaatcaagacctaactggttttaaaattaacattaccgacaagtctggtcttcatctggtaaacatttttaagccagaaagtaacaaggttattcaagaaaaattctatttcctcatggatagcttgattgaccgtgacatctttacaaaagagagttagtatgattgaaattcactatcttgacgcttacaagcaagaacgtatccaaacatttgagaataaggatgcagccattctggctttttccggttgcttaaccctcccagactattatccagttaccagcattacacaaaacggacaagctctggattacaaagggacaatcggagatctctatcgctatttacaaacactagattagacagtttcctgtttaatctttttttaaaatcaatctgttgattttttcacaaacttggactagaatagaataaagaactgtttaatatataaataatcgataaagcgtattctatcgaaataaaggagtctaaagtgaaaaacgataaaaaatctgatattccacgcgctactgccaaacgtctatccctctactatcgcatttttaaacgtttctatgcaggaaatattgaaaaagctagttcaaaagaaattgccgaagctatcggaatcgattcagctaccgtccgccgagatttttcctattttggagagcttggtcgtcgtggctttggctacaacgtcaaagagttgatggatttctttgcggatattctaaatgatacctccatcaccaatgttatgcttgtaggtgttgggaatatggggcgggccttactacactatcgcttccacgaacgaaataaaatgaaaatagtcatggcttttgaagcagatgataatccagctgttggaacgacagatgaaaatatcccaatccatgcaatctcagaaatcaaggaacgtatcagcgaagcaaactctcagaccgccattctaacggtacccagcgtcaaggcacaagaagtgaccgatattcttgttgaagctggtgtcaagggaattctgagcttttcaccagttaacttgtctgtcccaaaagatgtcgttgttcagtatgttgatttgactagtgaattacagacactactctactttatgcgaaaaggataagcaatgaaaaaaccagttattggtatttctggaaatgaatataaaacaggggatcatacagaacccctgctttcttatacccagacttgcctcgtacaagctattgaagatgctggtgggctcccactcatccttccagctacagagccagatttggcaaaatattatattcatcttattgacaaactcatcctaacaggaggacaaaatgtccagccaagttactatcacgaagaaaggactattgacagcgataattatctaccaaagcgtgacgagtttgaattagccctcataagggctgcccaagaaaatcagaaacctatcttcggtatctgccgaggtctacagctctacaatgtagctcaaggtggtagccttcatcaatcaatttctgaacattggcaagacatagacggacaagaagtcagtcaaacgattcaactgactcaaaatagtccactttacgacatatatgagtccgatccgagtgtgaactcatttcaccgtcaggctatcaaagacttagcccctgacttagaaatcattgcactatcagataatcaacagattattgaagcagttcattcagcctacccaactaaatttttaggggttcaatggcatcctgaactactctacggtaaacgtgagattgaaaaagacctcttccactatattgtcaataaactttaaaataactcactttcttctctaaaagaatagtaatccttatttccaacaattaaatgatctaataataccagtcctagcttttcgcaggactcttttaaattctccgtaaatagcaaatcattcctactaggttgtactgaacccgacgggtggttatgaacgatgataatcgatgttgccatacattttactgcgtaatgcaaaatttcacgtggttctgcaatgctacgattaacactcccaataaaaatcgttttttgactgataatctggttctgtgtattgagataaagtgcaactagatgctcctgcttcttatgcccgatttcatgaatcatcttacgtcccaacttctcacttcccaaaattctctcatttaagagtagctctgattgattgatacgttttccaagttcaatcatagccttaatttcaatcgccttgacgcgcccaattccagtcaaactttgcaattcttcaattgatagttctcttagagccgctaaactctccaaacgattcaataatttattggagagaatagaaacaggttctttttttgtcccagttctaataaaaattgctagtagttcctgattactgagacgctcagctccaacttctactaaacgttctctaggtagaaaggcctcttctttaaattcaatttgatacataatttcctcctcacctatctattcgtaaaatcttgcaaaaaagaagccatataaaaccaaagattatctcctcagtcctataccacttctttatccttaatatatagatgttttattgtccataatcatactgattataactcttattgaaggaatctaagatgtcttttgccgtttcattatatggagtggttgattcaagaactccttttacaacaatacgttgcgtagcataatagtccgtacatgtcactaacgtaacttctgtacgtccttctacatcatcaatgacatagacactttcaggcgaaacaatttccacactatcaataacgtaggtgtaaacattggtcttgtcagtaatatagattttcatgccgtttttagcacgatcaagcggtgaaaagagaacatctgccgcaccagttacaccaaaaatatggtggctggccaacgcataatttcctttccccatctcttggttttccttcatggtaccagctccatacatgagcgaagtattgaagacccctttaaaaataggaaggttgataccaagctcgggaaccgcaatcccaccaattacaggtaagcgttgtgcatcccactgagctgctaaaatagcttctgtagaaatagactgaacctgttcgaaatcaaatgttgtctcagcctgtttattcttttcgatatcctctgtcgtaacattgctaatctggtatttattcgtattccagccgataataaaattacggatagaggtgttgaatatcaatgccaaggaaatcagtatcaatacaactgttaaaagattgcgccaaaaagaacctttacgcttcttcttgttttcacgttttgacatgactatttattccttttcttctttaatttcggcagcatctaccaaggcaaaggtcatgattttcgcttcaccattcaagcgcatcacttttacccccatggttgaacgaccagtttgagagatattggcaacacttgtacgaataatcacaccagtatcggtaataaccataatatcttcatcaccagataccgttgtcaaacctgccagagaaccattcttatcagcaactttaagagtcttgatacccttaccaccacgacctttggttggatactcactggctggtgtacgtttaccaaaacctttttccgtcaatacgagtacttcttggtcatcagaaatcatagtagcgccaactaactggtctccctcacgtaaattgataccacgaacacctgttgctgtacggcccatattacgaacatctgtttcagtgaaacgtacagaataaccgaacttagtccccataataatgtctgcttggccatttgttaagaaaacattgatgagttcatcgtcttctttcaaattcaaagctttcagaccgctctggcgaatattggcaaattctgacacactagtccgttttacaacaccttggcgggttgcaaagaagagatagctatctgcctcctggtccttagttacattgataatggtttgaattgcctcgttttcttccaatttaagcaaattgaccactggaagtccctttgcagtacgaccatattctgggatttcatagcctttgagacggtaaacacgtcccttattagtgaagaagagcaagcgatcatgagtgcttgtagagactaattctcgtacaaaatcatcatccttgacgccagttccttgaaccccacgtcctccacgcttctgagcttgaaactcatcctgtgccaaacgcttgatgtagccttggtttgacaaggtgattaaaacatccgtttcttcaatcaagtcctcatcttcaagggatagaacttcaccaaccatcaattctgtacggcgtgggtcagcatatttacgtttgacttcttctaattcgtctttaataatctgaacaacacgctcaggcttagctagaatgtcagccaaatctgcaatcaaggccactaactcatcatattctgattgaatcttgtcgcgttccaaacctgtcaaacgacgaagacgcatatcaagaatagcctgactctgacgttcagaaaggtcaaatttctccatcaattcagcttgagcaatagcatcagtttctgaattacggataatacgaatgacttcatcaatatggtcaagagcaatcagcaagccttctaagatatgagcacgcgcctcagccttttctttatcaaatcgtgtacgacgagtgactacttctttttggtgttcaatataagactctagaatctgacgtacagaaagaattttcggtacaccattttggatggccaacatgttgaaactaaagttggtttgaagctgtgtttgcttgaataggttattcaaaataacgttagcagaagcatcacgacgaacttcgataacaaatcgtacaccctcacggttggattcgtctcgaacagcagtgattccttcaatacgtttttcttggactaatttgacaatatgttcttgaaccttggacttattgaccatgtatggaaactctgtaacaacaatgcgttcacgaccatttccatattcttcaatttctgtgcgggaacgaagaactattgaacctttaccagtttcataagcacggtgaattccagatttccccataaccaaggcacctgtcggaaaatctggtccaggcaagacttccataatctcacgtgttgttacctcgggattgtccataaccagcttaactgcctcgatagtctcacccaagttgtgtggaggaatgttggtagccataccaacggcgataccagtcgttccgttaaccagaaggttagggaaacgagcaggtaaaacctcaggctcacgttcactcgcgtcatagttatccgcaaaatttaccgtgttcttgttaatatcacgaagcatttcaagcgcaatcttgctcatacgtgcttctgtataacgctgagcggctgctccatcgccatccatggaaccaaagtttccgtgaccatcaactaacatgtgacggtagctccaccattgtgccatacgaaccattgcttcgtaaatcgcactatctccatgcgggtgatatttacccataacatcccctgtgatacgggctgattttttatgtggtttatccggtgtaatccctaattcattcatcccatacaaaatacggcgatgaaccggcttcagaccatcacgtacatcaggcagagcacgtgaaacgataacactcatcgcatagtcgatgaaggatgatttcatctcattggtcagattaaccgttactaaatttttatcttgcattatatgcctctttcaacagtcattgtgcttctattataccatattggcgaataaatttctttgttggaaactagcatgtaaacattttcaaaggcgctttcacaagtgacaaaaagcttaaaacatgctagaatgtattatggttgggatgaagtcatccccaaataaaactaaggagatgtttagcaatgactgcaactaaacaacacaaaaaagtaatccttgtcggtgacggtgccgtaggttctgcttatgcttatgctcttgttaaccaagggattggtcaagaattgggtatcatcgatatcaacaaagaccgtactcaaggtgatgcagaagacttgagccacgcattggccttcacattccctaaaaaaatctactctgctgagtattcagatgctcatgacgcagacttggttgtattgacagctggtttgccacaaaaaccaggtgaaactcgccttgaattggtagagaaaaaccttcgtatcaaccaacaaatcgttacagaaatcgttaactctggtttcaacggtatcttccttgttgctgctaaccctgttgacgtattgacttactcaacttggaaattctctggattccctaaagagcgtgttatcggttctggtacttctcttgactcagctcgtttccgtcaagcattggccgagaaaatcggtatcgatgcacgttcagttcacgcttacatcatgggtgagcacggtgactcagaatttgcagtttggtcacatgccaacgttgccggtgtgaaattgtacgactggttgcaagacaaccgcgatattgatgagcaaggtcttgttgacttgtttgtatctgttcgtgatgcagcttactcaatcatcaacaaaaaaggcgcaacttactacggtatcggtgttgcacttgcacgtatcactaaagcaatctttgatgatgaaaatgcagtacttccattgtcagtttaccaagctggtcaatatgaaggtgttgaagatgtcttcatcggtcaacctgctatcatcggcgcacacggtatcgttcgtccagtcaatatcccattgagtgacgctgaattgcaaaaaatgcaagcatctgctaaacaattgaaagacatcatcgatgatgctttcgcaaacccagaaattgcagctggtgtaaaaaactaattatataaaatagtaaaaaaggtgagcaatagctcgccttttttaccttctaatatcatagcgtaacatagcaattccatctgtgacagttgactctaccaagagcaatttcttttcttccaaaagtgaggcgaaaagtggaataccgtcacccaaaatagtaggaataatcccaataataaggtgatcaatcactcccgcctctaaacagtcctgaaccagacttgctccaccaaacaaccaaatatctccaccttctctagaacgaagttccataatctacccgatgatgtcccttacgaaacgcacattaccatagtccgtctgctcggtatgactcgcaacgataaattgcttttcctgatatccttcaatcatttccaacggacaatcttctaatgattttctccccatcacaactgtatcacagttgttaaagaatttttgattatcaaactgtaagacagtatcgtatttatcggtaccatgcccttcaatccaatcgtagcttccatccttacgtgcaataaatccatctaaactcattgcaatatttaacaccaatcgtctcacaattaatctcatttcataccttagtgacaaactattataccagtcattctccctattctcaactaaaagtccctctagctcctcttcctttgaataggacaattattcatttcctgtacagcaaagaacatgataaaaaggtccactggacctttttatttagatttgatatagttgataccgtctgttttaggagcgactgctttaccaaagaaagcagacagagcaataacagtaatcaaatacggtgcaatttgaagataaaccgttggaatatctttcaatcctggtaattgtccacccactactgccaaactttgcgaaagaccgaagaatagactggcaagcatagcgccaattggattccacttaccgaaaattacagctgctagagcgatgaaacctgaacctacgattgttgttgcagagaagttgatattcactgattgagcacttacagctccaccaacaccaccaaggaaaccagcaatcaacacacctgcataacgcatagcgtagacattgattcccaaagtatccgctgcctgcggatgttcacctactgaacgaaggcgcaaaccgaacttggttttataaaggatgaaccaagcaagaaatgctgttgcaatagctacataacccatcaagcttgtatttttgaagaaaatttcaccaatgattggaatatctgccaagatagggaatgaaaatttaccaaatgattcagtaatactatcagtttgacccttattatagataaccttgactaggaaaactcccaatgctggagccaaaaggttcaacaccgtacctgatacaacgtggtctgcacggaaattaatcgtcgccatcgcatgaatagcagcaaagacaacaccagcaagacctcctacaataacagctaataatggagtagcattaccaaatgtccctgcaaattcgatattgaaaacaacaccagcaaaggcaccgataaccatgattccttctagaccaacgtttacaataccaccgcgttcagagaaaactcctccaagactggtaaagattaagggcgctgaataaatcaacatttgcgaaatgagtaaggcaagaattgaaacattcatcttatttcgctcctttcgctttatttctagattttaataattgttcaaaaataaatttcacaccgataaagaaaatgattgatgccgtaaccacgttgatcaattcaggtggaatctgtgcacgtaccatacctggagcaccgacagaaagaacaccgaatagaaaggcagccaatggaatacctaacggtgaattagaagctaaaagcgctactgacataccattaaaaccaatatccaagttaccactttggatataaacgttttggaaagtacccaaaccttggatagctcctccaagacccgcaagagcacctgaaataatcatagatagaataatcgtacgtttcgcagacatacccgcataatccgatgctgttgggttaagccccactgagcgaatctcaaaaccaagagtcgttttggtcaataggaaccaaatcacaaaaactgcaataatggcaaagaaaataccaatattcatacgtgagttatctgtcaatgcacggagccactctgtttggtaagaggcatttgctgacacgttaactgtcgagtctgtatttttcatcaaactatctgcaaatacatcacgaatgatatagttacatgaatagagtaagatgtagttcatcataatcgtaacgataacttcacttgttcccaaataggcacgtagaatacctggaatagctccagcaataccgcctgccaacatggcaattaagactgttcccaaaatcaaaactggacgtggtaagtcaggatttgccaaggcaaaccatccagcaaaaacccaaccaacataggcctgaccagacaaaccaacgttgaagaaacctgcacgactagctactgcgaaaccgagagcagtgaaaacaagtggtgccattgcacggaaaatttcaccaattgatttgatattaccaaaagctgaatagaataactcttcatagccccaaattggatcgtagccaaaaacaagcatgacaatcgctccaagtaggataccgctgaccacagccattaatggaagggccaaattcttatatttattaagcatgttcttctcccttctcaatatgtccacctgccatcaagacacctaactcttgtttattggtcttagcaggttcaacaataccatggatgacaccatcatggataacagcaattctatctgatacatccaaaatttcatccaattcgaagctgacaacaagaacagctttacccttatcacgttctgcaataagacgcttacgaatatactcaatagcaccaacgtccaaaccgcgtgttggttggctaacaatgaaaaggtctgggttgcgatcgatttcacgcgcgatgatagctttttgctggttaccgcctgaaagagccttgattgggacgagttcacttgccccacgaacgtcaaattcttccattaacgcgcgtgctttttcattaatgatattatagttcaagataccattttttgaaatcggttctttatagtaagtttgaagcgcaaagttctcagcaacagtcatcggaagaacgagtccatcacgatgacgatcttcgggaacgtggctcacttgcatttctgtaattttacgtggagttttaccaactacttcctcacctttgatagtgattgagccagattttaccttacgtaaaccagtgattgcctgaatcaactcactttgaccgtttccgtcgataccggcaataccaacaacctcacctgctcgaacatcaagcgataagcccttaactgctggaataccacggttttcattgacaaccaaatccttaattgacaaaatgacttctttaggactcgcttcaactttctctgttttaaaggaaacggaacgtccaaccatccactcagccaaatcttggtttgttgctccttcaacggcaactgtttcgattgatttacctcgacgaataactgttacactatcggcaactgcacgaatttcatccagtttgtgcgtaatcaaaataatagatttaccttcttcaaccaaggctttcataattttcaagagctctgcaatttccgcaggggtcaatacagctgtcggctcatcaaaaattaaaaggtctgctccacggtaaagtgttttaaggatttctacacgttgctgtgcacccacagaaatatctgcaacctttgcagttggatcaacttcaagaccatatttagcagaaagttctttaatttctgcgatggcttttttaaggtcaatcacgccacctttggtggtttcagaaccaagaatgatgttctctgcaactgtgaaagcatcaaccaacataaagtgttggtgcaccataccaatacccaattgggctgctttggatggagagtcaatcttcacggattgaccgttgataacaatttcaccgcttgtaggttccaacaagccagcaagcatgttcatcagagtagatttacccgcaccattctcaccaagaagggcatggatttcaccacgtctgacattcaaattgatgtggtcatttgctacaaattcaccaaatatcttagtgatattgcgcatttcaatgacataatccttagtcataatctattatcctttctgactatagccttctgaaaattcttcagtactactttgagtacttaaaaactcttcatcaactataccatttttgtcagtaaaacctaccatagctgataggctttactgacaaaaatctcagcccgaaaacggcgccccgtcgggtcgccgaatcggaattgtcgaaaagaaattcattaaggtttttcaggaacttctactttgccatccaaaattgcttgtttagcatctgcaactgctttagaagcatcttctgaaagattagtttctgccaattcaacacctttatctttcaatgagaattgaagtacttgaccgccagggaaatcacctgcagctgccttagttgcaatatctttaaccgaagtaccaacttgtttcaatgttgaagccaatacaaagttagaagatttaccatctttagaagtgtatgtaccttctgctgattggtcacggtcaacaccgattacccaaactttatctgcttcattacgagtttcgttttctgctttagcagctgcaaatacaccgttaccagtaccaccagaagcgtggaaaataacatctgcacctgcagcatattgagcagctgcaagagtttgacctttagcagcatcaccaaatgaacccgcatagtcaactgtaatcttgatgtctttgtttacagacttagcaccagcaacgaaaccagcttcaaagcgatcgatgataacaccttccataccaccaatgaaacctacgtgatttgttttagttgatttagctgcagcaacaccagcaagatatgatgcttcatggtctgcgaaacctacgctaactacattgtcttgatctggaacaacactatccacgattacatagtgtgtattaggattatttggtgcaacctcagcaatcgcactctccaaggcaaaaccaataccgaacacaagattgtaaccaccagcaacagctgaatcaaggtttgtgatataatctgattcactagctgattggaagtaatcgtagccattacctttggaaagactagctgctttaccccactcttgaagaccttcccaagcagattggttaaatgaacggtcatcaacaccaccaatgtcagtaacgatagcagctttcacagatgtgtccgctgatgaagatgcttctgagctactgctttttgaagcacggttaccacatgcagccaaagatacagccgcagcagctgctagacccagtccaacaagtttcttgttcatttctgaaccctcctaaaaatctttttgcaactacattgttgcagagtaatattgctacagtcaaatgactgtcatacagactacgttaagtctgtaaaggaatatggtagtaattccccgactgtcgtctcgactgtcgatttatctttagcgaccaaggtcacttttaaatccttatcaaaaaattctgccataacttggcgacaagctccacaaggagatattggtttttctgttttaccataaataatgatttcagaaaaatctttcacaccttcagaaatggccttgaaaatagctgtcctttcagcgcaattggtcaaaccaaagcttgcattttcaatgtttacacccgtaaatatttcccctgtcttagctacaagaactgcactaactggaaattttgagtacggtacgtatgctttttgactgttttttacagctaattcaattaaatcaatagtctccatccgcctgtgctccattcatgattgccacgcctgatgacgcaccaatacgagacgctcctgcttcgataaaggcaatggcatcttcatacgaacgtgcaccacctgaagccttcactcccatgtcaggacccactgtttttctcattaaggcaacatccgctactgtagcaccgcctgtagaaaatcctgtagatgttttaacatagtccgcaccagcttcttgagataattgacaagctttcactttctcatcatcagtaaggaggcatgcttcgatgataactttgactagtttatcaccacttgctgctacaacagctttaatatcctccaaaaccaaatcgtaatttccagttttcagagcaccgatattgataaccacgtcaatctcatctgctccatttgaaattgcatcttttgtttcgaacgcttttacagcaggtgtgtttgctccgagagggaaaccaataaccgtacaaacttttacatcactatctttcaagctttcagctgctaaagcaacccaagttgggttaacacagacacttgcaaaatcatattcttttgcttctgctaaaattttttcaacctgctcttgtgttgtctcaggtttcaagattgtatggtcaatatatttattcaatttcatagctttctccgtacattaagaaataatctcgatgatttcttttgtttttacactttctttatctattttaacatttttttggaaatttgtaagcatgttttccgaaatattttcattggcataaatcgttgcgatttgttcgcctttagaaacagcttcccccactttcttatggaaaacaatacccgtttcataatctaaattgtcagttttgactgcacgacctgcaccaagtttcattgcaaagagaccaaattccaaagcaggaagtcccacaatatagccatcctcttccgcaagaactggaacttgctgtgtaacctgaactgggcgatataaatcttctaagtcaccaccttgagcacggaccatctcttcaaatttcttcaatgctgcaccattgtcaatatgttgacgtacttcttcaatgcttttctcaacattagcaagccccaacataatttgggctaattcacagataaattcggtaacatcttctcgacctttaccctgtaaaatttcaatagcctctaaaatttccaaacgatttccaatcgaagttccaactggttgagacatgtcagttaaaacagcaactgtcttacgaccaaccgctttcccaagatccaccatagtttgagctagaacccgtgcttcttcaacagtcttcatgaaggcaccttctcccaccgtgacatctagaagaatcgcatccgcacctgcggcaattttcttagacattactgagctggcaatcagcggaataatgtcaacggttgctgtcacgtcacgaagggcatagagtagtttatcagctttgacaagattatctgactgaccaataactgcaacaccagtatcttgaacttgcttgatgaaatctgcttgactaacttcaatctggtatcctttgattgactctaacttatccaaggttccaccagtatgaccaagcccacgaccgctcatctttgcaactggaatatcaaaacttgctaccaatggcgctaagatgagtgtgaccttatctccgacaccacctgtagaatgcttatctaccttgatgcctggaattgcagacaaatcaatctgttcacccgttgcaaccatggacatcgtcaaatcagaaatctcacgcgttgacatccctttaaaataaatcgccatcgctaaggctgacatttgataatccggtactgtcccagctacatatccatcaatcaaccatttgatttcttcagacgatagttctaagccatcacgctttttttgaattaaatcaactgctctcattctttcacactttcaaggatgtagtaacccttatctttctttataatctggcagttgccgaacacctcttccatcttagctttagcactcggtgcgccttgtttcttttgaatgacaatggacaaggttccgtgtgcctctaagcgttgaaaagccccagcaattacttcatgtacaaccgattttccggcccgaataggtggatttgaaacaatatgattaaatgtttcgtccacattctcgtagatatttgattgataaattttagcgataacaccattcctctctgcattttttgtagctaaatccaaagctctgctattaatatcaatcagtgttgtcttggtactaaacaccttagcaagtgtcaaaccaattggtccataaccacagccaacatccaacactgatgcccctttttcaaaataaaggttttttaaaagcacttgactaccataatcaaccatcttcttgctaaaaacacctgcatctgtcatgaaagacattggggtgtctagtaagtttacgtggatttcatgaatatcatgtgctattgtaggatttttttcgtaatacatattggacatgtacttattataacatttcctaaaaacgttttcaagagtttttcttacatgaaaaatatgataaaatgaaatcgatattgaaacgcttacctataggaagaattatgtatgaaaaatgaatttttaaattttgaacaaattgaccgagccacttggcaacaactacatcgtaagactaccattccacttagtcaaagcgaactaaattctattaaaagttttaacgaccgcatccaattacatgaggtttctgacatctatcttcctttggttaatcttatccatatctatcggaaagcacgcaaagacctaaattttacgaagagtttatttctacagaagactatcaagccacaaccatttatcattggcgtttctggaagtgttgctgtcggcaaatcaacaactagtagattgctgcaaattcttatcgctcggacatttaaatacgccaaggttgaattagtaacaacagatggttttctccagccaaatgcggttttagaagaacggcaactgttaaataaaaaggggtttcctgagtcctatgacatggagaaattgattgatttccttgataagataaaaaacggctacgactgccaaatccctgtctattcacatgaaatctatgatattatccccaacaaaactcaggaaattaagtctccagatttcttgattgttgaaggaatcaatgtatttcaaaatccacaaaaccagcgcctctatgtcagtgactattttgacctgtctatatacgttgacgctgatgtggagcatattgaaacctggtacttggagcgattccaaaaattattgacattggcaaaaaatgaccctaacaactattaccatcgttttacccagatgacgtaccctgaaattctatctattgcccagaatacttggaaaaacattaatctagctaacttagaaaaattcattgaaccaaccagaaaccgtgctgatattattcttcataaggccgaaaaccatgagattgataaaatttatctaaaaaaataaatttcacttgtcaaaaatactcttttcagatataatggtgtagttagtacaagaaagggtggaggtgaaaccattggcaaacattaagtcagctatcaaacgcgctgaattgaacgttaaacaaaacgagaaaaactcagcacaaaaatcagctatgcgtactgcaatcaaagcatttgaagctaacccatctgaagagcttttccgtgctgctagttcagcaatcgataaagcagaaactaaaggtttgattcacaaaaacaaagcaagccgcgataaagcacgtcttgcatcaaaacttgcttaatcatgaccacccgtcaaacgggtggtttgaacaagggctataagcccacatcaccagccagcgcctaaagacgctggctttcactttgttcaagcctcactgcttttgactcgtcactagcctcttaaagaggcattcgtactacttgccattatccctaaagggatcttcatactcttttacactcaacttatcaagtgctatatcatgtttttcctgttcttgtatatatttcttaattgtggcttcatttagtccaaccgtacttacataatatccctctgcccagaaatgacgattaccaaatttgtatttgagattggcgtgtttatcaaacatcattagagcactcttaccttttaaatatcctataaagcttgatacacttaatcgcggaggaatactgactaacatatgaacatgatccggcatcagatgtccttcgataatttctacgcctttataagtacacaaacgtcggaatatttctcccaaactacttcgatattgattatagatgatttttcgtctatacttaggtgtgaagacaatgtggtatttacacagccactttgtatgtgataaactatgtgccttttgcgccatatttttctcctttcgctttacaataggcttgaacacctttattgtatcgcgtttggagtttttttggtgtaaccttcgtcgcgcacccgcatagcgggtggtttatttgtcacgcaccttacggagcgtgacggactaaaagtcacataattaaaaaagaaacctttgggtttccttttttttttattttttccatcataaggaggcgggacaaagtggatcagttttccctcgatgagtaacatcattaactcgtcaaccgtaaagccctcactaagattatacacctagtgagggctttatgttcgttttcattattctgtgggtgaggcggagccatcatggatgtctttcccactccctattttttattattagggaagaacacgctcctggagattcaaactaattccttaaaaccaatctgccagttcaaatgtataggtttggtcattataatagtactgatactctcctacatcgcccaaagcctgaaaaatagcattattttcagtagaggccaatgtaatcatttgttgcattgcttctgctgttccgaattgcaagactactttattcgtaccttgtagccgctggtcagtgatggactgtaaaactgcagcttcatcaaagcttgtgaaataaactcccttttgaacatagtaattcaatgaattatctgtacactttggataggtcaatgctctaggttcgtaatattgttcttctccccagtagtcgagtaggtcggtatcagcaattctacttctctctaatatttcatcagggacacatagataatcgtatgaaatatctgtatgcgcttctccacttatagcttgatcaaaaactggatctccccaagtcgtatcgacaccatagtattgtccatttatcttgactagattccaagcatgcccaaactcaccgttttgcccattttttgcaatccctgtgacatagatacaatcaatgcctgcttttttacatagatattggaaggtgcgactatagccagcacaaacggatttcttatctaatagcacactggtaattccttggcttctccacgtgacagagttggtttgtagggcttcaaggtcgtaatccgtttgctttataatcacctcgtaaaaatatttaaccttctcatagtccgaccctgtcggtgcctgagcaagtatcttattcacttcctcttctattttatttcgtgtcggagataaatcagtcggatacactggctcttctaaatccaatatatcaactccgccactcattgctgcttcatcagttagccagtaaaattctggataatcatgagcgacagaaaaatagacgcgcgaatatatttcatcattaacagaatcaatatcgatcacttgcatccgcttgctgagcccattaacaaattggagatagacacgacgttccttatcagtatccaattgttggtagtagaaatttccttgaacctcttcttttaatgctgttaattctgcttctagttgctttttttctttagaaaattcaattttagctgcttccaaacgttcactcagctcttgtcctcctcctgaacaagcagaaaggactgtcgctgataataatatggttaaaacgccacgagaaactttcctcatatttacctacattcttgtttaagtataacataatcaggagacttctgacgaactacacaaaacaaaaagggagtggaaagaattcaatagatcgaaaaagaattcccctcacttccaaacatttaggttcgattttctatggtcactttcttatttttaggtgaccagctgaaacagttccccaaacctttggaggctggagatagagcgaacagagttcgctacaaaactacctgggagacagttggaagttggaaattggaaatagagcgaactttgagaagaaaggctggattttttacccaacctctaatcttgatgaatggttagttatttgggtaaacgtacctcaaaaatagttcctttcggttggttatctctcacagaaatctcaccatctagattcttaataatttgttgagctaaagataaacctaaaccaaatccacctttttgacgtgttctagccttgtcaactcggtaaaagcgatcaaagattttctttttatcgacatcgctgattcccaaaccattgtcaataactgtaaaacaaactagtttgtccttgatattagctgctatttgaattgtcccatcatcatcggtatacttcatagcgttgtcaaacaaaatggtgagcaactgtttaatcaaaaccttgtctgttcgaattggctgatgaatcaaattattaactgttagagtttttccattttcttcggcaatcataaggtaattagcaaagatttcatcaaaatagttgggttggacatcgatcatatcgacttttaagccatcatcacgacgagccaaattgagcaagttcgttgttaatagtcgcatatttcgaacttcttctaaactagatccgatgctttcactactttccaaaatagttgtctcgggatgacgaaatagactttccaggcgattttgaagaactgccaacggtgtgcgtaactcatgactagcattttcaacgaagtctttttgtttttgataactaattaggattggacgcatgctaagattcgataggtaaatacttgctagtatagaaatcaaccaagctgataccataacaatagcaactgtcgattcatagctctcaatggaagatttaatttggctgacattcaccaaaattgtcgcatattttatatcataggacgaataataacctagttcatctgtagccagcccaatcgttatatagcgataatcttcagacataccaaaacttgattcaaccgtagtttccttaatttcacccaatttttccttatctaacggtaggttggccaaaccagtaaaagtatccggattgaccatttctccacttttactatagagtaagacatgagtattgacacctaatctcagctgatctccatctctagtatttttttgttctttaggaacaggcatgctatctgagctagagctcgtcgtttcttcactagttgggctatcttgaagtataaagacagagttgggctcataggttcttgcgatcgcaaaaccaacagccatcgctggttcttccttaatccgtttcaaggtattatctgaattttgatacatagttgaacgcattaattgaaaaatgatagctgtcatcaagccaaaaatcagggtaaatactgcaaaataacggataaagaaggaaaatttatccgtatacactaattttccgattcgcttaggcattttttagaatgtacccgacactacgcagggtttgaagattttccccaaaagtcgttcctttcaactttttcctaattttagaaacatatacctctactactgaaattgtagtatcactgtcaaagccccaaatacggtcaaaaatttgtgtttttggcaaaataacattttgattttgcaagaaataaactagtagatcaaattcttttcctaacagttcaacttcttcgccatttaccatcgtcatatttgtagataggtcaactgtcacatctccaaaggttagtgtgttttcattaaacttacccgctcgttttaatagagcttgaattcgcatcttcaattcttctaaataaaacggttttgtcaaatagtcatcagcccccaattcaaaaccatggcctttatcctctagactttccttggctgttgtaatcagaactggtgtcgtaacccccttttcacgtaactctttcaagacttgaaagccgtctttttcaggtaacattaaatccaaaagaatcaaatcataaacgcctgtttccgcctcataaacgccctcttcaccatcaaaaacctgcataacatccgcaaaatcatctaagaaatcgaaaacagaatttgatagacttaaatcatcttccactaacaatattttaatcatcatacacttccttacgtttcggtttaataaacaaaccaaagacctgggacaggtcacggtctttaagagaaatggttagataaagtactactatgaccatctgaaaaatgaatgataaggtagtctttatctaactatttattgatacgagttcattatatcatggaataagtaaaaatcgaaatctcaatatttattgattagaagaactactatctcctgaaatttgagctttaatttcttgattcctcttttttaaagcattcacttcatcagaagaagtactcgagtttgactgagttgctccacttgtcgcatcaggaggagttataccttgtcccggtgatatatcttgtgtagctcctccctgacctggtagcatgccttgggtagctacttgtccactcttagctacggaaccattttgcgccaaagttacctgactttgtgttgaaactcctgctgagcttttagaaatactcattccccctgcaaagcccaagatagcaactgaaatagcaacagtagctagtactgtttttgactgtgacttaaattgattaataaatgacatgaaattccccttttcaatagaatattatcagaatgagacctgttaaataactcctcttcacctgatgataatagtatagtattgaaaacttaaaacaagctaaagaaattcagcattttttataaaagtccattacacaaaaacatactaagattagtagtgaggaaatctccgacgggagaaagtactcactactttttctttatgataaagtagaggtgtcttgttaagtcgagggtgcttttgacgctagacgtcgcaacaaaaactggcaagacacctgttttagaaagaatgttatcaaagtatgtgggacgccagacgtcgagtattgaaaatgacatcgctaaaacaaggaatcattcaagacaaagaggtaatatcatgcgagtagtttttgggattgatgtgagtaaggcaagttcagaagtggccattctagtcaatggtgagaaagttcatggctataccatatccaatgacgccatcggctttgctcggctacttggcgatttgagaaccgtccataagccagaaatcatctttgaagcaacaggtgtctattctcgccgtctccaaacttttctagatgataatggctatgcttatacacggcttaatcccttagaagctaagaagcaactggatagcttgcgtgtgcggaaaacagatcaaattgacgctgaaaaactggctcaatctcaatttgtgctgaatcgtaaacccacttatgtccaagaagaagtctaccaaaacttgcgggatctcagccgtttctatcagaatctgaccgaggatattgttcgagctaaaaaccgcctgcacaaggtcttacaggtcactttccctgaattggaaaatatcttatcgacaccatctggcgaacaatactggaacttagttatagcttttccttgtaaggactgcgtacttgagttaagcaatgatgaactctcaaagagcatccgtctgtccacttcaaaacggatttctgacaagcgtgtggcttacttagccgagaagcttatagcactagctaatcaatcttattgtgccgtcaagaaaacctctccaatactggaagaggtccgttactatacaaaagaattgcttagactttctgaacagagacaggcagtcttagacgaaatggtggaactagctcagccattacctgaatatgacattctgctctctattcctggaatagctgagactactgcaacaagtattattggtgaactgggagatattcgccgttttcagtctgccaatcaaatcaatgcctttatcggtattgacctgagacactatgaatctggtaacttcctcgctaaggaacacattaccaagcgtggtaatccctacgctagaaagattctgttcaagtgtatccacaatatcgcttcagccaatcataccaatccttgccatatcgcagacttttataagaaacgaaaaagacaatcgcaaacgacttcaacgaagctgcacacgattgcctccatacatcgtctcattcggacaatgtattacctcattatgcataacaaattttacgattacgcttcaacccaaaatcggtaaaactgtttatgctctatcattgtaacaccttatcaaaaaatttcaacataaggtgttggttttgtatgcactttttacacgtaactttagtccaaaataaaacaatttccttatttggatgacgagacacaaaatatttttcgtcaaataccttgatgaacttgacaaatggtagaaaagaagccctctcggacttctgaattacaactctgtaatatcacctgtgcgtagataaacaacccactcacaaatatttttagcataatcaccgacacgttccaagtaggttaaaacttggtaatagtcgcgaccagcaaccaaggattctggattcttcttgatttcttccgttgtcaattcttgaatagttgaatagaattcattgacaacctcatcacgtgctgctacttcataagcgcgctccatatcagcatcacctaagtagagttccaaagtttcttctactaattgacgaacttcacgtcccattttcttgatttcttcttcaacaactgggatgcgaacttctcccttcatacggatagctgctttagcaactgagactgcatggtctcccatacgctccaaatcactagttgcttttaagactgtgataacgcgacgaagatctgttgagacaggttgttggagagcaatgatttcaagtgattttttctctaatttcacttcgaaagcattaattttcttatctgcttcaataacttcttttgctaattcacgatcatgaattgtaaaggcacgaacagcattattaatctgagccaatacttcatttcccatggcgtaaaattggttatgaagttttcctaattcctcttcaaattgagctcttaacatgtgaacctctttctttttcttataggccttagccgaacttacctgtaatatagtcttctgtttctttattggcaggattcaagaacatttcttttgtcaaattgtattctatcaaatcgccatcaaggaagaaacctgttcgatctgaaatacgtgatgcctgttgcatagaacgtgttactagcaccattgtatacttatctttcagaccataaagtgtgtcctcaattttaccagctgagatcgggtcaagggctgaagttggctcatccaacaaaataattttggggcttgttgccaatacacgggccacacatacacgttgctgctgaccacctgaaagtccaactgctgagtcatgcaagcgatctttcacttcattccaaatagaagcaccaatcaaggaacgctcaactgcttcgtccaagacctgcttgtccttgataccgttaatacgtaaaccataaacgacattctcgtagatagacatcgggaatgggtttggttgttggaataccataccgatttccttacgaagatcaacagtatccgtacgaggactgtatatgttctttccgttgtaatcaatcgcacctgtcaatgttacctctgggtttaaatctcccatacggttaatagaacgcaagagggttgacttaccagaaccagagggtccaatcaaagcagtaatttcatttggatagaaatcgattgacacattattcaaggcttttttcttgttatagtaaacagacaaatcttttacttgtaaaataggtgatgtcatttgtttcctttctatccaaaatgtcctgaaacgtagtcactagttgacttgagttttgcattctggaagacatttgctgtcttatcatattcaatcaagtcacccagatagaagaaagctgtgtaatcacttgcacgagctgcttgttgcatattgtgcgtaacaatgataatggtgtagtccttcttcaattcaaacatagtttcttctaactgcatagtcgcaattggatccaaggctgatgcaggctcatccataagcaagatttgtggttttacagagatagctcgtgcaatacacaaacgctgttgctgtccacctgataaggtaaaggctgacttgtgcaagtcatcttttacctgatcccaaagggctgcttgtttcagagaagtttcaacaatctcatccaaaacctgcttatctttcacacctgcacgttcatgtgcgaatgtgatgttgcgataaatcgattttgcaaatgggttgggacgttggaataccattccgatatgcttacgaatttcgtaaacgttcatatctggtctattgatgtcgattccttcataaagaatttgaccggttaccttagcaatatcaatagtatcattcatacgattaagactgcgaagataggttgatttcccacaccctgatggtccaatcaaggctgtaattttatttttttcgaactgcatatcaatgcccttgattgcttcatttttaccatagtaaacatgaacatcttttgtcgaaagggcgatattctcctctggaaaagtaatgatatggcgttcattccagttgtaatctgccattttttctccttataagtcagacttctaggctgctgaagtcagtttcgcatgaagtttcttaccaatataacgtgcagaaaggttgaaaatcaagatgaagaccaagagaatcgctgctgaaccagcagaaacttgggttgcatctggaattgtaccttcgctgtttaccttccagatatgaaccgcaagggtttctgattgacggaagatagaaatcggactagtaacactcaatggattccagtttgaccagtcaagagctggagctgactgaccagccgtgtagataagagctgctgcctcaccgaagatacgaccagatgccaagacgatacctgttacaatccctggaagtgcttctggaataacaacatggagaacagtttcccaacgtgatagaccaagagccaatcctgcttcacgttgtgtatggtgaacgtgacgaaggctgtcctctacgttacgtgtcatctgtggtaagttgaagactgtaagagccaaggcacctgataagatagaaaaaccgtactcaaactgaacaacgaaaatcaagtaaccaaacaaaccaacgacaacggaaggtagggatgacaaaatctcaatacaggtacggataaagttagtcaatggaccttttttagcatattcagccaaataaatacctgcaccggttgacaagggaacagaaattaagagcgttacaaccaataggaagaatgagttgtagagctgaattccaataccaccaccagctttgtaagacgaagatttacttgtcaaaaaatcccagcttacatgtggcagaccacgtagcaagatgtaaagaatcagtgacgtcaagataacgacaatcacaccagcgattgagtaaagaataccagtcgccaatttatcaaattttttagcgtgcatagtttttcttaccctctctcgtaataaatttcataatcatgttaaagataaggctcatcaagagcaagactagggccaaggaccataggacgttgttctgaacagttcccataactgtattaccgatacccattgtcaaaacagaagtcaaagtcgctgctggcgttgtcaaggaagtcgggataaccgcagagttccccactaccatctgaatagccaaggcttcaccaaaggcacgcgccataccaaagataacggccgtaaaaatacctggcttagccgcgttcaaaataacacgccaaatcgtctgccaacgagtggctcccatagccaaacttgcttcgcggtagtgacgaggtactgcacgtaaactgtcaaccgtcataaaggttactgttggcaaaatcataacgaaaagtacaaatacacccgacaagataccgaaacctgttccaccgaagattgaacgtacaaatggcacaactacttgcaaaccaatgaaaccgtatacaaccgatggaataccaaccaaaagttcgataacaggttgtaagatttttgcaccacgttttggtgatatttctgtcatgaagaccgctgcaccgattgcgataggggtcgcaacaacagctgacagaatcgtaacaatgaaagaacctgaaatcattggcagggcaccaaatattttcgagcttggttcccacttgcttccaaataagaaatcagtgatgctcacaccgtcaacaaagaaagtcgataatccacgctgtgcaacgaaaatcaaaatcattgcaacaataaagacaatcaatgatagacaaaggaatgtaattaccttaccaaacttctctaatcgagaatttttagatggagacgataactcttttgctagttgttcgtttttcatgcttactccttctcagtcaccgtgccatcagcacttttcacaactttcatatcgttgatagaaatgtatcccatactttcaacgataccattttgaacttcatctgacatcatgtaatctaaaaattcttctgtcaaatcagtcgcttttcccatcgtatacatatgctcataggaccaaattggccaatcatttgttgctacattttcagcagttggttcaaaaccgtttaacttaattgttttaacggaatcatctagataagcaaatgataggtaggaaattgcacctggtgtctgagcaacaatagattttaccataccgttagaatcttgttcttgactctgagttgcggtttgtccatccatgataacactatcaaaggtcgcacgtgaacctgaactagctgcacggttaatgattgaaatttccaaatccttaccgcccagctctttccagttggtaatctcacctgtaaaaattttacgcagatcttctgtagtaatatctttaaccgatacctgctcatttacaataacggccaaaccagctactgctacttgatggtcaacaagtttacttgcatcaataccatctttttcctcagcaaatacgtcagagttaccaatctgaacagctccagactgaacttgtgacaagccagtacctgaccctcccccctgaacgttgatggatttaccgatattgacactaccaaattcatctgccgctgcctcaacaagtggttgaagcgccgtcgaacctacggctgtaatagactctcctcgatcgatccaagaagaacaaccagaaagagccatactactcaaaagaaacaaagctgcaattccaagcttctgcttttttttcatttcattttttcctttacatttttcagtggaatctcctaaaattaactctgtattttacatagaatttacaagatatttccactcatccactatatcatataaaaagacaagttgcaaaaaaaatttgctgatttattttaaaatctcaacccttttggaaagccgtttttaagcgttccagatacaatttttgcgaaactaagaccgttcccctggactgctacctgataccagccattagctaaatccttggacacagctatggtatgtcctgcagtataggacgagaattcttctaagctgatttccactcgattttcaacctccgaactatggagtgctagacctaaagcaaaacttggttcaaatctttttttcttatacgtccccaagtgaagaccatttcgagcaatctttacttttgacaaatcaggaaggccgtgtggcagtaggtagagattgtcgccaaaaacctgcagtaaaccatccaattgaacccttaaatgcttctgttcaaattctttccagagagattgttgttctctattcaaattagattttcctggttttaattttttctgactggcttcccctagaaatctaaatttggcaacgaactgaccttctcctgcaaaatggtggggatacatacgagcaacttctgtatatccgattccttctaccattccattgattttaggaatgtctattagttccaaatcatactgttctaagagccaagtcactacttcttcattttcctctggtgaccaagtgcaagtagaataaatcaattgaccatctggagccaacatgttcaaggccgattctaaaatttcacgctgtaagcttgcacattgtgctggataatgtttggaccaatattgaatcgcatcggggtattttcgaaacatcccttcacctgaacagggagcgtctaggacaatcatatcgaaatatcctggaaagaccttttccaagcggtctgctgattcatttgttacaacaacattcctcgctccgaaacgctcaatattttcagccaatatccttgctcgtttgttagaaatttcattactaaccaagagccccgtattttctaagtatgaaagcaagtgagtagactttcctcctggcgctgctgccaagtccaatactttcatcccttttttcggtgctgcaatctgacctacaacctgtgcagctggctcttgtgagtagactaagccagttacatgttctggagatttccctgagaccttaccatagtatgaccaagtcatattagggattggttgctcaaagtccaattggctttctttaagaggatttgtgcgaaatcctgagattgggtcttgttcaaaactctcaaaaaatgcttgggcttcactaccaagcaaatgattatatttatctataaaatcctgtggtaattgcattagaatatataccccttcacttcctcaagatgggattctgatactagcatgacaaactctcgcttatcataggccagactcggaccctcaaaacttaacatgactaagcctaaagaggaaccaataatactggctgctgcgtagtcccatggacacagataagaagcataggcaaataatcttccttccagaacgtgggcgaaaccaattccagcacttcctacagatcttgtacctaaactttgatttgctaattctgccactccatgtgcattgcctgcgtacaactttgcattgattcctatcaaactctggcgaagagggcgcagctctggtttctttaagcgttcttgattgcaaaaaacagggaatgaatctcctccatggaaaagtttgtctcgcatgacatcatagatgataccgaactttcctactccattttcaaaataggcaatcataatggcaaaatcagttttctgagcaataaaatttgtggtgccatcaattggatcaataacccaaacatttccctcatgaatagaagaaacgtccccaccttcctcgcctaaaatcccatcaccttgatagcgagattgaatctgttgagtcaacatttcttgcacttgtttatcaaggtgtgttaccaagtctgtaaagtcacctttttcttcaatctgaagatcatcatgtaaatgctgtcggagaaaatttccagcttccaggacaatcgtttgggcaaagtgatacttagtttccaaaacaaataactcctttccctttatctcgagcagccttaacaactcgataggttgaataaccagaaactgcttcaaagtcacgatcaatttgacgttcctgtcccttacttttaacaacatctttgaagcttttataactagctaatatagctaccgcatctgctcctttttcataagctgcctccacctgattcaaaaaagaaagcacggaggaaatctcctctgtgctccacgaaaaatcaagtggatatgaataatttttgttcatatcttttatctttcttatcctatttctgctctcaatgtagcattttttagttcttgtttgcgatacttccgcggaagaaatgcacgaatttcatcttcgttaaaaccaatctgcatccgcttctcatccaaaataatcggacgccgtaagagactcggataggtttcgattaacccaataagctgcttcacagaaagctcatcaacatcaatatctagtttctgaaaaacttttgaacgggtagaaatcaagtcatctgtcccattttctgtcaatgctaaaatgttctttaattcctcagcagttagagggctagtcataatattgtgctcaataaaagggacttcgtgacttgtcagccaagcacgagctttacgacaactggtacaactcggtgacaaaaataaagtaatcatgtcttccatcccctctaaaaacatttttcttcttattattatactctaacttaaaagagttttcaatagtaaatctaatctcttccctgtaattcacctaattttcctaaagattctatttttttctctaagcgtaataatgtttcgttttgttcatcaatttttgccatcaagatatccaacttcgtttctcgctctgtttcagagaaaaaacgagttattgtggaggtaaccataccaaaagtacaaataccaaccaacatcaagaggatggctataattttagaaatcgtatcttgggggacaatatctccataccctacagttgtcatcgttacaatggaccaccaaagtgcatcgaagaatgattttccttcaattactgataataagacacttgaaactagcactgctgagatatttaacatcaacactttggataaactgttggtatgcaaaagcttgttgattgtatcccagaatcgattagacagggcaaatattctcgttactttgaccaatctgaagagtcgtgcaagtcttcccaagcgaagaaaactgaagaatgaatcaaatggaataatggcaattaattccaagatatgtccctgtacatattcaagtatgtcatccgcataataaagctgagcaaaataatcgcaaacaaaaataaaccataagagcaagtctagtacccgatacccactagaattggcaatactagcatccattaattcaagtacgataagaaatacatagactacagctatgtaggtcatagccttctcataaaaaggatgacgaatcaatcgtttaagcatatttcccccattgcaaggcaaatttctcatcagatttcatctgctccatcaatccttcaattccatcaaatttgaccatatctcgaattttttcaagccaaaaaatagttattttttctccgtagataaagcggtgaaacccaaaaatatgggcttctatccgcatctccgttccatcaaaggtcacatttttcccaacgcttgtcatagctcgatagcgttttccatctacttcgacatcagcgacgtagactccctcagatggtaaatggacacggtcaaaaggagccagatttgcagtcggatagccgatggtgcgtcctctggcatctccatgcaccacaattccctccgtcataaatggataacctaaaagttgattagctagagagacatcccctgactggatagcctgacgaatacgagttgacgaaactttctctccgcccaggctcacttcacttacaatttctacctgaccatcaaataactctgtcaaatctttgacatctgctctgcaatttccaaaatgatagtcgaaacctgcaaccaaaatctgggcattgagacctttaatatagcgctccataaactgctgaggagtattattagcaaattcactagtaaaatcagtcaaaataagattatcaacaccatattttttcaataagaggtagcgctgctcttgactagtcaaatgcagtaaaagttctgggctaaagcgagaaaaagccaatcgaggtgactctggaaaggtcagaacagttactgtcaaaccttgctcatctgctacttttcttgctcgatcaagtaaagctttgtgcccaagatgaagcccatcaaagtagcccagtactaaaaccgtcggctcctcttgattcaattcactataatgtttaattgttctaatgttcatgttttctattttatcacagttattgagaaatttcttagaccaaaaccttgctcggtttatacagctggtcgcgtttttcaaaaatagcaatcaactgaccatcatgaaagcctgctaagcgctctgcttctgcattcaattcgacaaatcgaccaaatgtagcatcttgcacctgctcttctttcaattctacaacaggtaaatccccgataccacgttcaataggttggaggaatgaaaaatcattttcagctaccagcgaagaaatttcttctaaagtcaaggcatccgctaggtccattccagctgatcctgttcgttccaacttggacatatggctggcatagcccaacttagcccctaggtcaacagacagggtgcggacataggtgcccttaccacagcgaactcggaaggtaaaccgtgcacagtcatctgctagttcaatcgggctagtccgttcaaaactgtaaatctcaatttggcgttgaggacgttcaacttcttcgcccgcccgtgcgtattcgtagagtttacggcccttgaccttgacagcagagtacataggcggaatctgggtaatagtgcctacgaaactggtcatagcctcatcaactgcctgctctgctatgtacaaaaccggtgtccgctcaacaagatcgccagatgcatcttctgtcgtggtagagtaaccaatggtaatctccccctcgtaaatcttgccctcttcctgcatgtactcaatcatgcgcgtggccttgccgactgcaatgggcagaacacctgtcacatatggatccaaggtcccaccgtgaccaatcttcttctcctgcaaaatcttgcggagcttaaaaacaacatcatgcgaggtcatacctgcctctttttttacattaataattcctgagatcatgttctcattataacacaaaggaccgctcttgtgggcggtccggtatcaatcagtcatcgtagaaacgatagctaccgaatgttgtacctatcaaattctctagttccttatgaatacgtcgcatggttccagaaggtgctgcttcatatgcaactgcctcatcaatgctttcctcagcctcctcatcatagccccaagaaaatatcaatggggcatcataatagccttcgtcaccaatttttatggtcggccaatccaacagcttgatttcctttcaaaaattctctaaatttttttgccttgctgatacgaatagaagtgtaatctactgaattctcaactcgattatctgcacctatatattcaatcatatactcctgctccctaagactgaccgcaacatctacgctctttccttcaatataataagccttaaaaagaataaagtcaatattctcgtatgtacgttcaaattgtttcatgttctttcctttcaaaaatgactaaactagatatcccgatgaaaatcgctatcaatctcaaaaaatggttgaatatcctgaacatactccaaaacgccttgaaactctccttggtcatcacgcaccgccttatagactacatagacaaacttgcccatgctctcggacttgaaccacatggcgtccaatctggcttggtgttcgtttgaaaatcatgtcttcgacagggtggctgtcattgtaatattggaaaatgtcatccttgttgacaaaggttaattccagcggtaaatgattgaggataagattcgcttgctcaacagataaataaccattgccgaaggtctgcggactagttctgtcctgaacagtttctgacttttccttgggtgtgaaggcaatggtaaactggccttctggcgtgtcgataatctgctgatttggtcctgctggctgcagagaaacagcatttacttcctgctctgctatttcccaaaaagcctcccgatgaggtacccacttggctgtcggcttgacaatggcgtagccgtaggcgtcactgtctactgccacttggagccagtcgtcctgggtgaaaatctccagcaaaatcatgagaagtatggcttcttccttgaaaatcatctcctcgaactccttggcgaagttttcaaagtgagcacgtgtcgcagctaggtcacctccttcaagtgccttacgggccgtcttgaagagatcgcgaatctcgtcgtccacaccccacatgaccttgggcggtgcatcataaccgtaccgctccataatgggaaagaagaccttttccttgcgggtatagtggttttcaaattgaccgaggaggccaaactggcgtgtcaaaccttgcaggagctggtctttcagctccgcatcctctgtctgctcatactggtcaatgatacggcggatgcgtaagagagctgcccgcagggcaaggttttcctgcttaaagacatagacagggtgtccttcccggtccatatccgccacatccacatccgcaatggctcctttgaagaggttggcgtggatattgcagaggctcatgacatcttcaaaagtgatacccgtatcgctggacatgagttcatgctccatcatggagatttccaaggcagaaactcccgtgaaatgctgattaaactggtcctgaacagactctggactggccccattgtgcaggtccaagagaatattcttcagaatgtcaacacgtttttcggtcatgcttctcctcctattacctcgtagccgttgcattccaagacctgttgaatacggtctagtggaatcttggtcatcttagatcctgtcttcagactggttaccttaccaactgtgttcagcatagctggatttgccaagggcttgaaaccaagctctaccagaatgtccttgacttctgggtgctggttgataatctctgcaacaggcagatttaggtcgatggtgttcattttacttttcctctataatttttttgtaaaatacaaggccaattcatcatcgttataggctttggcacctactggcaaagagcaccctcggtaccagacaccgcttccgtctggtatgaaaccatgttttacatagagccgttgagcctttccataatttgcattcaaaccaactccaatacctactgtatccgtaaattctgaggcaagttggcagatagcatctaatatagttaaatgaaacaaaaacagtacatttatgatataatgtatttatggcatattcattagattttcgtaaaaaagttctcgcatactgtgagaaaaccggcagtattactgaagcatcagctattttccaagtttcacgtaacactatctatcaatggctaaaattaaaagagaaaaccggcgagcttcatcaccaagttaaaggaaccaagccaagaaaagtggatagagataaattaaagaattatcttgaaactcatccagatgcttatttgactgaaatagcttctgaatttgactgtcatccaacagctattcattaccccctcaaagctatgggatatactcgaaaaaaaagagctgtacctactatgaacaagaccctgaaaaagtagaactgttccttaaagaattgaataacttaagccacttgactcctgtttatattgacgagacagggtttgagacatattttcatcgaaaatatggtcgctctttgaaaggtcagttgataaaaggtaaggtctctggaagaagataccagcggatatctttagtagcaggtctcataaatggtgcgcttatagccccgatgacatacaaagatactatgacgagtggctttttcgaagcttggttcaaaacattcttactacccactttaggtaaaccatctgttatcattatggacaatgcaaagtttcataggatgagtaagctaaaagatttatgcgaggagcagggacatagacttttaccacttcctccttactcaccggaatataatcccattgagaaaatatgggctcacatcaaaaaacacctcagaagagtattgccaaattgcgatacttttcttgaggcactttcgtcctgctcttgtttcagttgactataattgccaacctatcccctgattttgaaagtcttcaaaaacattgaaatcagcaatttcaggtattccagattggtaaaactgtccctccttcacttgcttaatcaaggtgatataacctttacaaacccccgtttcttcagcaactaggacgatacgttctcccttttcttgttcccttaaatagttggttaaaatctctttgcgggagggccaaccttgcttctggaaggcctcatcaagttgaagtatatgctcaaattgtaacggaacaatcatctcaatcctccctcaacgcctcaaacttggctttcatggttgggttattgcgggttagttttttgacggagacatcgtctagtttattattagctaggcgaagctggttttcgctggtggtcagggctgctttgacagcctccattcgcttgattgccttgtcgatttcatcaatagctttttggaaattgttgctggccgattgatagtttttggcaaaagcattcttgaaaatttccaaatcttcttcaaaatgagtaatatcaatattctgctccttaaccaaggctaactcctgctgatattgcagactattgagcgcagcatttcgtaaaattccgattaattggataaagaactgtggtcgaataacatacatcttctcatattcatgactaacatccacaatccctatattgtaatagtcattgtccgcctctagcatgctgactaatacagcatattcgcattttttctcccgacggtccttatccaactccttaaagaaatcagcgtttttatgcttggtcttggtcgtatctgcctcgtttttcatttcgaacatgatggaaataaattccaagcccgactcgtcaaaatcacggaagatgaaatctccttttgaaccggacgctgatacttcgttgtccttagcaaatttggcacgtggaaaagcataggaacgaaccttgttaaactccgcctcagcaaattgctccaagctctctccaattgccttagtagactgctgagccttgaaatttttgtaaaattccacctgctcatccgccgccttgagccgtacttcgtactcctgacgagtggtcgccagggctaactcttgcttttgttcctgcaaaaccaaagcattttgtgccgcatccctctctttttccacctgagctaccgcctgctgcaactccaagtccttggcgagaccgatttgccccaactgagccttaagctcttggatttcttggtctttttgggaaatagcagagctgatttccagttccgtctgactagcaaatttatcaagttttgcggtcagttccagaatctccttatccttatcactcaatctagcctgcaaatcattttcagccttctggcttaataattcccgttcccgctccaaacggtcgtagatttccttatcaaactccgcaccacgcacctgggctaaaagctgactatattctgtttcattgacctgaaaggccgtcccacaatgggggcaagtaatttgatgcatatactctcactttcttcttttcaaataagatattaatttatgtaaaaccgtagctactcccagcgccaataaaaaataaaagaaacgaaccgcatttctagcatctggaagtgatagagcccaaaggacaaaaatcgttatggcagtcggccatctccagccccaggtcatcttccgtttgataaaccattccatccaatcttcattagaatcaaaccgtgtttcataatattcttctttcagttgttcccaccactttttcataacagcctcctttcagatcacagaccttctaattcaagctccagaaaagtcctccacttttcctgcaagggttgacacacaggcggctcctgaccttctaagaattttttgatacattcattttgcaccaaccagcctgtcatgtctttttgagcattcgcaaattcattaccaaaatcttctggaattcgttcttcaaaagtaatcaaggtctgattttctagctgagacagtgcaaatgaaactgttgctgaatcccacctgtaggcaattttctcattttttcggtattccagtaaatccataacttcacgaaatccttccatttcaaaaaccagcgtatttcctacaatgttcaactgtggaaaccagtgggcaaaaccactgtctgtcgccaacaaatcccaggactccgccaaactagccgacacagaatagcaaatgctgaacaggtagtgccccgcctctttcttcacactaatcttcatatcatgctcctattctatccttctattaattataccaaaaaacaccggtctataaccgatatttccattgtctctattctttaagcatgaatgctattcattccagaggatcgaaaaacggtatcttgaaatctgaattattttttataacatctttcatagactgtccttacctttgtttatctggctcatactccatgttttgtatcccctagcaatgttagactttcctgccacataatggacattgtcatttttgaaacacttctatatttcattcgtcacctaatttattttaacatatagaacagagtttagtatttcaatcattcctttctcattttatgctatactagatgtattgaaaacaaggaggtttatatgataaaactaatcgctcttgatatggacggaacccttttaaacgagaaaaaagagctgatgcagccacagattgatgccattcatcaggctgttgaagcgggcttcaagattgttctttgtactggtcggcccttggctggtgttaaacctttcgtagagcagctcggctttgacaccgaggaagaatttatcattgtcaataacggctgttcaacccattcgacaaaggattggagcctgattgactgggaagaactatctatctctgatattgattatctttccacttttattgaaaatgctgatgtgcaaatctctctttttgatgaggaagactacttcgttcttgcagaaaaagccaatgcacgcgttaatttagacgcaggtttggtaggaatgactcctcaaccaattgatttaaaagaagcccagtcaggtcagtatcgcttctttgaagccatgtttgtcggtgaaaaagtgcatattgatgcctttgaaaatcaacacaatcctgtactcagcaaacgctattccaccgttcgttcacaggactatctcttggaaattttaccaaacggtgccagcaaggcctctggtttaaaaaaattggcagaccgcctcggtatcctcccagaagaaatcatggctatgggagatgccaacaacgacctggaaatgattgaatttgctggacttggtattgccatgggaaatgccaacgagcaggtcaaggctatcgcccaggacatcacagacaccaatgaaaacaacggcgttgccaaggccattgaaaaacacattttgaacaaataaggagacaatatgaaatacccaacactcttagaccgtttcttggtctatgtcaaagaaaatactcgctcagatgaaaattcgacaaccactccttctacccaaaaccaagtcgagtttgcacagaatatccttctgcctgaaatggaacggattggtttgcagaatgtccactacctaccaaacggttttgcagtgggaacactgcctgccaacgacccaagtttgacccgcaagattggcttcatcgcccacatggatacggctgatttcaacgcagaaggtgtgaatcctcagattatcgaaaactacgacggtaacccaattgccttgggaacttctggctatgaattgcatccaaaagacttcccacaacttgccaactaccacggtcaaatcctgattaccacagacggtactaccttgctaggctctgatgacaaatcaggaattgcagaaatcatgacagctattgaattcctaatccaaaaccccgacatcaaacactgcgaaatccgtgtcggctttggtcctgacgaagaaatcggtgtcggagcagacaagtttgatgtgaaagacttcgatgtggactttgcctacactatggacggtggaccgctgggcgaactccagtacgaaaccttctcagcagcaggtgcaaagattgatttcctaggacgcaatgtccacccaggatctgctaaggaccagatgatcaatgccttccaaatggctattgatttccacaatgcccttccagaaacagaccgccctgaaaaaaccgaaggatatgaaggtttcttccacttgatgaacatggagggcagcgttgatactgcttctaccacctatatcatccgcgactttgaggaagaagatttccaagcccgcaagcaactcatgctggacatcgctgaaaagatgaatgccaactttgacactccacgcgtcattgtcaacctacatgaccagtactacaacatgaagaaaatcatcgaaaaagatatgactccaattaacattgctaaggacgttatggaaaatctaggcatcaagccactgattgagcctgttcgcggaggaacagacggctctaagatttccttcatgggcattccaacaccaaatatcttcgcaggtggcgaaaacatgcacggtcgcttcgagttcgtcagcttagaaaccatggaaaaagccgtcgatgtcatccttggaatcgtcgcttacaaataaaatttcaaacggctttcaatagaaagtcgtttttttctgaaaaaattttaaaaaaatgccattttatgttgtgttattgaactaatactagtataatagaactataaaaaagaaatggagttttattatgacagaagaaacattagcacagggaattctcattggcatttggggtacaacactactattttcatttatttggtatattcttgttgctatttccaactacatcctcttcaaaaaagcaggctacgctggttggaaatcattgattccaatctacaatctctatatccaacaatgcatcaccttcggctatgaaaaaagatggttcattctattcttactaattccactagcaggaccattatatggcatctatctcgtttacaattttggtcgtagcttcggtttatcagctgtacaagctatcttctatgttcttcttacacctatctttaacctctacatcgcctttaatgatggaagtcgttaccaaggtccacaagaattctttattgattaatatacaatcaagcccccgcacacgcggaggcttttttaaacgaatagaaaaataagaagaaccatcatgactaggctgaccaaaatagataaggagttaacgttggcaggttcagctgagcgactacctaactttaatgcataaattggggacatgactgaaatcggagaaactagacagaccagcaacatgattttcatcgttttatcaataggtagaagaaaataaatgactcctgctattagaatattcgcacccagcctcaaagagagaagataggccaatcgactaatttcttgccaattcaattttaaatcaagcaagattcccaacatgagcatggctaaaaaaggattggcgttactggctatcgtcagcgcagagataagttcgcgtggaagtttgatagagcagactgctaacgataggctaactagatagactactagtggaactgagcgtgaaagattctttataaaagttgcaacggtcattctttcctgctcttcatccacaccagctgcgatactgtaattcccacctagaaccatgattgcattccccgcatcaaatacgatgacacttagtagactagatagcggaaaaaaagcttgcacaaatgggagtgtaaaggttccaatattatagcctgataactgcataagaccgacggaagtctgttgaccagacttctttgcttcccagtatcctaccatatccaaaaaaagattacaaagaatccctaatatgaagggaaggtataaatctatagatacttgggttgtcgctgaagctacaaggagagaagctggtagcgtaacattcatcactaagctagaaaagattcttgcatcttcccttcgaacaatccctttgacttttaatgtataacctaaaccgataacaaagataaaaccgagagcacgggctaataattcaagttcattcatgaaactagtatagcatatagaaaagaattttgatgatatataaaaattttatataatcgcttgattttgctaaacaataggtatataatttatatataaaataattacataaagataaagaggtgagtttatgtactaccccgtatcctctatcttgatagaatttctggtcttagccatcgtggaaaagcaggattcctacggctatgaaatcagtcaaaccatcaagatagttgctgatataaaggaatccacactctaccctattttgaaaaaattggaaaaggcgggctacgtcaccacctatacccaagaatttcaagggagaaagagaaaatactacaccatcacacctgctggacgtgagcacatccccttcctgcaaggtgaatggaatagctacaaagaccatattgacggaattatagaagggagcttacgaaaatgacacgcgcagattatttgaaccaactggaacaagcattatttcaacttcatccaagtgccagacaggaggctttagactacttcaatgaatattttgacgaaaaggataacgacgaggaagctattatagagctaggaacacctgatgaagcagcaaaggaaatcattgccaatctacctgaagatgccctaatcaccgagcaagaccaagcaagtccacattcatctaaaccatttgatttcaactttgattttgattttcaatttgactgggagaattttttcaacaattttaaacattcagcctatcaagctagggaaagaattaaattgacggcgaagattgaagaattacctgagttttcaaatctacagatttcgctcgaagatcaggctcttagcgttcaaagttataacggagaagctgtcttattgcacaatcctgtttcagaagatggtagctaccaggcttttgactatcaactggttcaggatagtttgtacctaacaagcaagcctacccctaatcacctctacttctcaaacaatcaaaccagctctgctattctcaaaatccctaaaaaactactgccccttactagtctcaatctgaaaacgacagatagtagtctgacgatggcggctgtgcaagcgagcgaacagctagtcatcaatgcaaaagatagcagtatcagcatgacgaaagtgagctgcccaagctctgctctacggttagaagactctacactaactatctcagatggacagatgagcgagttaaaattggaagccagcgatgctgttatcactctctcaagcatgagcctttcagatgcaaggataacattagaagactgtgtctggaagttgaaggattttgttattgaaaagagccttaactgccaggctgaagattctgtcttaacctataaaccaagtacggacatcagtttagacatctgggaggaagattctagccttaaacttccaaaggataaggcgtttacaatgatgaaagagggtgacatcactcatctcagctacaagcaagaaaatagccctgctcagctagttattcattgtcaagactgccagcttagtgtgggataaaggaggtttccatgaatcgcaaggaatatttacagaaactcgaaaaatatctcaaaaacctaccaaaagaagattttcaagataccttggactatttcaatgaatattttgacgaaaaggaaaacgatgagcaagctattcaagagctaggcagtccaaaagaagccgcccatgaaatcctagccaatctctatgataaagagaagactgaggataagccaaatacccgcaatatggtctggctgaccatcctctctatccttgccgccccaatcggcgtccccctagcaatcaccttggtcgccctcttcatcacccttctcctaatcatctttagcctctttctgctccttatctcactctggattgtcctcctcagtctagcaatcgcccagctactcctcgcctttgacctcttcacactatcatggtctacctccctcctcttcacaggcctggccctcatctgcttggccctcactctattgggtagtaaattcactctagaccttggaagcaaaaccttcttgcttgttttacattggatacaaagaaagattcgcaaaggaggctattatgaaacagcttaaaccatttacgaaaatcagtctgagcctgttcactcttggaacaattctcagtctcattggctacctggctggcggttggacaaatatgaaaactgttgcagaaaactattttcagccccaaacggcaagctttacggatattcgttctatagaggtcaatgaaaaactgtccattatgccctcgcctgacaaacaatttcacctccactattaccgaaatcagcacaaaggcattgacctcctcagccaccaagttcaagatggaaaattaaccatttctagtgcctatcaaggcatcgttacttatgatggtttactcgaacctatcttaaatcttgtcaatgaccagaatgttgcctactaccaacctgtcttacaggtccctaaaaatagcacaatcgaaacactctcagggagcattcaaggagatgtctatctggataaagtgactattcaagatttccaactctttgttgaaaatggtgacatgttgattgaaaacagtcaactcagctttgctcatttgtcacacctcaatggagaagtagcaatcaatcattccacattaataagtccgaaagacatttccgatactgtcggcagtagcttaacgattgaggatggggattttaaagctgaaaacctaaaactagaaggaagacatagtatcagtaattacggtggttcaatcgacatttctcttcattccaaaacaaaaactgacatccatatagatgccagtcaaaataatctgggaattgaccttccaacctattccaatccccaatccactaattacctcaacatctctacactagatggtgaattgagcattcggtaatcgctaaaaagccctcctcacggaaggcttttctatttatttaaacaacaaaatagagatcaatgccaagatagctggtccaccttgggttaagataatttttggacttgctgtaatagcaccataagctgctgcagcaataacacatagaacaaaaatgcttgtaatttctaaattaccagtaaaaataccgtagaacaagaagaccgccaacaagccattataaattccttgattcttgaacaatgcagtcacagacttacgttgtaattcttccttctccatattgaatacgcgactagtagagtctgaatgggtcgcaaaggtttccaaatacatgatatataggtgctcaatagctacgatactagctagaatagtggtaaaaatagacataatgtctcctctcaaaaaattatataggtagattttgcaagccaatcaatagtttatcaagagtggctaggaattgctcgctctcctcaacagttagaatctgattcatcgaagctttgatagcttggtggtgggcagaaggattcgtgattagcgcttctctagcctgctcagttggccagacaagtacttctctctgattgtcaggatttcgcttgcgaatgatatagccactctcctccaacaatttgagatgacgcgtaaccgctgcgcggtctatctgaagccgctcctgcaaagccaactgatgcaggggtgcatcttttagtaatgtttgcaatattgaatagcgtgtcaaactgattcccaactgcttttcaaaaagattggaaatcgtctcatctgtcactttcaatctgtataacaaatcttccatttcttgcattatctacctcttttgattgattaatcaatcattgatgagtcaattatactacaatccgaacaattttcaactattttgcctatctattaaaaaaatatgttgcctacacctatattttgttataattaaggaaataactagcagagggatgggacttacttatggaaaacactcctagactaaacttggtcatagacgtgctcatgctcgctggtgccattttggcacaaagcggtgcagaaattcaccgagttgaagataccatgattcggattgcacattcacaaggaattgaacaggccaatgtccttgccatccctgctgctatctttttctccatcgaccatacgaatatttcgcgtatgaaacgcattgtcaattcaaattacgacatgcagaaagtttgtgacgtcaaccaaatctcccgttccctagccaatgaagaaatcagcctagaagaagcatggagccaattaaatgcaatcaaacaacaaaagccaccttataacaatatccaaataaccttagctgccgtagtagccgcaccattttttaccatcatgttcggaggttctcttttagatgcagcaggtgctgtcctcgcaacagctttagctttccctatctccctaattgtcgagcgctatattggaattgattttgtcaccaccttcgttggcgcctttgtcttctcactcacctcttatttattaagcgcaaccactactctccccattaatcctaacctgattaatgcaggggcagtcatgccttttgtaccagggattgcttttacaaatgccgtaagagacctcatgaccaatcatatcaatacagggatgaccaaatttttccaaactgcgcttattatcttatcgctcggtgcaggtacaactgtggcctttatgcttgtgaggtaatctatgacaccagttcacttcttattacaggcactcgcctcttatatcgctatcgcagccttcttaattgttctcaatgttcaaagaaaaatgctggtccctggtggactcctaggcatgcttgtttggctcatctatctttcattattaggaccaactaatgtactgattgctacctttttcgcagcaattatcggatcctgtgtcagtcaaatcatgagtatttggttaaaaacaccctccgtcatcttttcattggctatacttgcaccacttgttccaggctatcgagcctacatgaccacgacttatttcgtttctggggaccacgctcaagccctaaccaatatcactaccgtcttaactttagccttagtcattcccatcggtatggccagcggaacaatattattacacctttataaggttcttcgaacaggcaaaaaagcagcctaaccccttgaaaataaggggcctttttgttaaaatgaaaacttatcaaaggagatgctatgaaccaaaacgtaaccaatctaaaacttgctgaacgtggtgccttgctatctatcggtgcctatattgtcttatcaggtatcaaactcgttgcaggacagctctttcattcggatgccttacgagcagatgccttcaataatatttctgatattatcggtaatatcgctgtacttgttggactaaaaatggcacagaaaccagctgataccgatcataaatttggacactggaaaatggaagacttggcaagcttgattacatccttcatcatgtttgtcgttggtttccaagtactctatgataccctccaaaaactaatcagcaattcttctatcgaagtagacattatgggggccattgtcggaattttttctgcactagttatgttagctgtttatttatataataaccgcttggcaaaaaaagtacgttccaaggccttagaagcagctgccaaggataatctatccgatgcagtcacttccataggaacttctatcgcgatctttgctgcggctttcaacttccctattgtcgataaaattgcagccatcatcattaccttctttatcctaaaaacagcctacgatatttttatggaaagcttctttaccctatctgatggatttgatgaaaacttattgaaaaagtacgaggaagatattctcaaactcccaaaaatcgtttctgtcaaatcacaacgtggtcggacttatggagccaatatctaccttgatgttgttttagaaatgaatccagacttatccgtttatgaaagtcatgaagtgactgagcaggttgagcaactcctaacactcaaacatggagtttttgatgtggatattcacgtagaaccatctgaaattccacacgatgagatgtatgagcatgtgtacgacaaactcttccgttttgaaacagagatacaagcacatgctaatgggtatgaagaattgattgacgaccagtatctcttaattgatgccaaaggccgctatcgaaataaaactcagatgcttgccgaccaccccatccaaaccacgtatttatccaattaccaaatgacctccattagccaaaaatcaaaattagttacgtttgaaattggtgattatgttcatacgtcactttggcgccgtcatgaaaattggactgttattttccaccagatttcaaagaaacaagcctctcagatcgaagctactgaaaaaagctctgatttgcataatccataataaaaaataggaattttccctgaattatagggagaattcctattttttaaccttccttttaagctattatcagtcttttatactcaatttgtagttatttagtttttgtttagtatatgataaaagctaaataactatagaagattagagcttactgttttgggatttcattgattattatattataaagaaaaagcctctacccgaataaatatttgagtagaggttttaactgaatgatattgcccattggcagggcttttatttgtttgttaatcaatcctaatatagcaaaggtgccaacagtaaaatcacaaataatgctaacaaatgcccaactgtcactaggataaacgaatacttgaggccacgtttcatacttaatttcgaaagattgtggaaggtaatcatcacaccagactgaggcataactgtcaaaatagccgatgcaactactactacacgatgcagcaactccggattaatccccatttccaaataggaaggaaggaaattacttgaagcaatacctatcgcaccagaagatgaaccgataataccactaatcaatgctgtcgaaacagataaactgattagaggtgatcctggtatttgttgaatccattcttgaatgactgcaaaacctgctgacaaagttaacacagtcccaaaggctactgtactagaagttgcaaaagcaggcactatagatgccgttgtcgcagcattcaaaatttctttttgatttggcagatatggataaaaaatcaaggctgatagaaggatagagaccaacaatccgattgccaggacattcggagttttactcattaggaaaatcgtcccaataagactgaatagaggcaagactgataaaaatagatttggtgtcttatcagctaccactactgcagtttcatcctcttcttccgtatacgtctctccatttgctagacttttcttgaggcagtaggccatgtagagcaagccaaatactaatagtgtcaagctggctgccaaactgataatgggtgccgcggtcaagctagttcccaaaacttttgtcggaatgacattctggatggaaggtgccccaggaagagttgtcatcgtataggtacctgctcccaaaaagacaggaatcggaaaaagtgcccagttgatattcaactctttaaagagggggcgtgaaaggggaagcaaggtaaaaataactacaaaaatactcacaccaccataggtcagaatggaagcaatcaaagtgatagctaacaagcccttatagggactatcctttcccattaccttcaaaatgctattggcgatcgtctgcgtagctccacttgcctccatataacgtgccaagatagaccccaacataaagatggcaaaattattaatcaaaaaacctgctaagcccgccatataagactgctctttgcccaacataacttccaaaacattcatctgattggtcagaatgatgattaaactagcgagtggtgcagcaatgataacatgtaaattttttgatgtccaataaataatggctacaatagccaataaaactcctaaagttgctaaaattgtcataaaactcctttatctattctatcctctaataaacctagtatcagaggcaactatttgaaaatttttatatctttttgttcccctagttctgcaagcaagtccgataccacttttttcaaaattgggtgacagtaatcagaagcaatctcagcaagaggtttgagaacaaatgctctttcatgggcgtagggatggggaacaatcagattctcttcttgaatcttctcctcatcccaaaaaataatatccaaatcaatggtccgttgtccccatttttcaatccgtactcggtccaactcttgttcgatgttctggaaaacgcttagaaaatcctgagcagacaaatcagtatacacttgacaggctagattgaggaaatcagcctggtcggtcttgccccaagctggagtttcataaatgttggaaactaagccaagctggcaacctggatgactggctaatttgtctagggctgcctgtaaataggcttgtcgattgcccatattccctccgatactgagataggctagatgcttcatggtcgttcacgctccaattcaattccgacagaatcatagtgtccagcaatgggcggattttccttgtaaatggccaagcgaatcttctccacctttggaaattgatcaaaaatctcctgacagatgacacctgccaccttttcaatgagaatatagggcttgccttccacaactgctttaatggtttcaaagaccataccatagtgaactgtgtcttctaaattgtcagtttgtgaagctgctgtcaggtcaacaaacaaatcacagtcaactgtgaaaatttgaccaagaacttgttcttctttgaaggcaccatggtagccgtaaaagcgacatttattgagagaaatcttatccatgttgacctccagaagtcaattggtcccaaaccttaacgatatcacggttggcagcgacattgtgaacacggaccattttacagcctttttggactgcccaggcagacaaggctgccgttgcttgatcgcggtcagtcggtaaactattgcccccaagcagataatccaccacgcgcttacgagatattccaaatagaacgggataaccaagggcagtaatctgttccaaaccttgtaagagatcaaggttatgttggacattctttgaaaagccaaatcctggatccaaccaaatctggtctgcggaaacaccagcatcaagtgctgcttgggcacgctcagctagaaagtttttgacctctccaacaacatccgcatagctttcgtctttctggttgtgcatgagaataattggtaccttgtactccgcagccagggccaacatatctccatcataaagtcctgcccagacatcatttaaaatatctgcgcctgcttccaaggctgcacgtgcagttcctgttttataggtatcgacgctgacaagacagtcatagttttctttgatagcgcggataatcggaaccacgcgagcaatctcgtcttcttcagacacaaatgttgcacctggccgagtggactcaccaccaacatcaatgacggtagcaccctcagccaacaacttttctacttgtaccaaggcagactccacctcattatagtgaccaccatctgaaaatgaatctggcgtcacattgagaatccccataatggttacttgattcgctaactgttcgattgacatagaacctcctatttattgtgaatcatggacaagagttcacggcgcaagatggcatcttccttgtatttgccaagagcaactgtggtcactgtcttactacctggcttgcgaataccacgcatgctcatgcacatgtgctctgcttcgaccatgacaaaaacaccttctggttcaagggcatcttgaagggcatgggcaacctgatgggtcaagcgttcctgcaattgagggcgacgacttgctacctccactgcacgcgccaatttgctaagacctgtcacacgccccttactcggaatataagctacatgggcaatgccataaaagggtaccaaatggtgttcacacatagaatgaaaaggaatatccttgaccaaaacaacctcttcatgaccttctgaaaagacagctgtaaattggtctttgggatcctcttctaggccgttaaacatttctaaatacatcttagcaacccgtttaggcgtatctaataaaccttcacgattcgggtcctcacccaataattccaataattgataaattgtttgttcgatttgttcttgttttgacatagtgcatcctaaatagtttgatgttcttattatacctcaaaaactgttttcagaaaagagctttcagtatgctaatcccaaaactgtcccctaccagagcaccaagcaggtgtccctactcccgcctttgtgatataataggaacaaactaactataaggagctactatgaccaagaaacctgtccaactggctacgatttgctacattgataatggcaaagaatttctcctgctccatcgcaataaaaaagaaaacgatgtccaccaggggaaatggattggggtcggtggtaagctggaacccggtgaaacaccgcaggcttgtgccattcgagaaatctttgaggaaactgggcttactgtaacgaagcatgctctaaaaggagtgataaccttcccagactttactccaaacactgactggtacacctatgtctttaagataactggttttgaaggaagtcttattgactgcaatgaaggtgacttagagtgggttccctatgaccaagtcttgtccaaaccaacttgggagggcgaccggcattttcaagaatggctattagaggacaaaccatttttttccgcttgcttccgctatgatggggacaaattgcttgattatagcgttgatttttatgaagaataagctaataaaaaacgaaaaagccttggaaatccagggcttctttgatattacaaatacttcttcttcggcatttgcttgttcaatacgacatccaaaggaccggctgacaatactgtatctaccaagcgtttatctgtaatttttttatcgaggagaacttgatattctaagatcagcgcttcttttttcttcttgtacttgagggaaatgagatccgcttgcttgcaggatgtaccaaattgtttctcaaaaaattggtcgtagtcaaaattcattggcactgttaccaagagatgacgacgattttgattgacttgagcaaagctgatgttctcaaaaatcaaaatacaagcagataggatgaccgtcataaagacagccaaacctaggaagcccattcctgtcgctagaccgatagccatcgctaagaggactgcaagcatttccttcgaagaacctgctgctgagcggaatttaattagactgaaagtccctgctaccgcaacacccgctcccaagttaccattaactaatgcaatgataacagcaatcaatgccggcatcagacttagtgtgatgacaaattcctttgtataattagatttatatttataaacagccgctaagagtacccccatggatagactaactccaaaaaccatggacatttgcgctaaggtaatattgctattggccgttgaaaagatactattaaacagctgcatgtttgcttacttcctctccagtgatgttgtgggcaagcttataggcattgccatattttgaaaatgattgcttttcgatttggtatttttcgagcagggctaccaaccagtctggtcgttcttctggaacttttacttccatgattactttggttgggtctaataggttcttaccaaatttaccttccattgcatccacatcgtagtctcgataaagtaagttcttatcgattgtgagacgaacttttttgtcttcgattcctttataggatacgcgatcgtagtagatatacatcttcggcttaatagtaccgtagcgttctctcaacatttcgagttctgaggttaccttatcatccttgattgtggaatcaatcactccattttcgatataatttgctacagaaacagggtttgaagttaaacggtatttatagccaattttattttcttttttcttgatttcaagaaaagcttgactcgattcagatggtgtcgcatcatagacacgcatccgaattttctcacgtccattctttttggcaagtgaatcttgaatcatatcaaaatcttcattatcaaagtagatattggtaatcgttgatgtcgcaaactcatctgccatcatgtactgacgaagttccttttctaaaagttcaaaagtttttttatcaacgatatatttagtctctttacgcttaaactgcttttgtacgattcttgttttcattattgtgcctcttctatcctaaattttgacaggtccctgtcttgtttacaagatatagtttaccgacctagctttaaatgaaactgaaaataaaattaaacaaaacttaaactgcaataaagttgaaattcttttgtcacattctaatctatgctacaatagtcctatcaatagtaaggcaaggagaaacccatgtacgaatttgtcctagaatacggctctttccccgtaaaactcatcgacggttttgtcaacaatcgctcagaaatccctgattttctcaaagaagacgaagaaatgattgcccgcttgaatgagattaacgaactcttccaccaacttttcttaaccatcgagtgcaagtttgactacatcggcaaacaatttcctgacaagatcgaacaactacgagaactctatcatcccctggcagacgatttactagccaagtatggcaaccagatagagttgaagattgaaccctttattttgtaagacaaaagagatgaccgcaatcatctcttttcttctattctgtattccaaaccatattggtcacgcgacaagtagccgtagtccaccaagtagcgtctcaatatagcataatcatcatagacttcagctagaaaggcattgacttctttttctgtgaaggtagagcctttcttagccaactcttcttgtaaataggcaaataaaacttgcttactttttaattttttaggaataacgataagcttgccttctcgaaaaaatttttcttgaatatcttgagtgttcatacttccctccaaaaaatcccagcccgctgactaggatttcacaagatttacatgttaacgaatttcagctccaagtgtttcgagcgacttactgattttctccatgtacttagccacttcctcatccgtcaagctatcctcaggattctggaaggtcaggttataagccatagacttcttaccaacctcgatattgctgccagcatagacgtcaaagagagtcaccttggtcaagcgtttcacgccagcaccagcaatggcatccaggacatcctgatgtttgacatcgctgttcaaaagcagggcaatatcacggctaaccgctgggaatttagagatgtcggtaaatggctgagcaggctggagggcttcttcaatcgcatccagattgatttcagccacataagtttcaggaataccgtagtccttagccgtttgagggtgtacctgaccgacaaagccgatcacagccccattcaaatggatttcagctgtacgacctgggtgcagggcagcaatctcactagtcgccacaaagtcaactgccaacttgtaatgatcaaagatagcttccaaaatccctttggcatggaagaaatcaactggtacagctggtgtctggaagtctttctcagcaaccaaaccagtcaaaacaagggcaaacttgttgatttcttgtggcaggtcctcttttggattgccagactgttcaaagatcttaccgatttcgtaaagagccaaattcttgttcttacgagccacgttgtaggccactgtgtctaacataccagacaccatgttctgacggagggcagagcggtcaactgtcatcggccacatgagttcggtgactgtggttggacgagccacaaactccacagccttgtcaggcgttgtcaaggcataggaaatgatttctgtcagacctgcaccttcagccaggctacgtacttggcgacggatgttctgggtcagggtcaactcgcctgctgttccgtcctctttcggaagagtggtcggcagattattgtaaccatagatacgagcgatttcctctaccaagtctgctggaatgcgaatgtcccaacgacgacgcggtactgctactgtaaactgacttgcatcgccagttgtttccatacctaaacgacggaaaatatctgcgatttgggcatagtcgaggttggtcccaagcgagcggttaacgtaatcaatggttgctgtgactgggacatccgaagtgtccacgctgcccgcagaaacgatgccagacaagacctgaccgccagccagttccgcaatcatagcagccgctgtgtccatagcctccgtcaaagttgctacgttgatgcctttttcaaagcgagaagaggactcagaccgaaggttgaggcgacctgaggtcttgcggatagacttgccgtcaaagagggctgcttccagcacgacggtcttagagctattgtcaatctctgtactagcaccacccatgacaccaccgagggcaactgccttgtccgcaacggaaatgacgatgtcatcggcaatcaagtcacgttcttcgccgtcaagagttaccaagttctcaccctcttttgcctgacgagccacgattttcttgccttcaaatttatcgaaatcaaaggcgtgcattggctgaccgaagtagagcaagatgtagttggtgatgtccaccacattgttgagcgggcgaatacctgcgttcatgagcaggttttgcaaccactgcgggctcggtgcgatagtcacattttcaataacacgggccgtgtaggcagtcaccttgtctgactcaatggccacttcaatcacatcgctggctttcttgtcgctttcctccaagaccactggcttgaagttgaccttgctgtcatagatagctgccacttcgtgagccacaccacgcatagagagggcgtcggcacggtttggtgtgatggacaactcaataatctcgtcgtcgaggtcaagatatgaaaagactggctcacccacgactgcatcttctggcaggtggtagataccgtccgcatagacctttggcacaactgagtcggacacgccgatttcgctcaatgagcagagcatgcccaaggattcaactccgcggattttgcctttcttaatcttgtagttgccagcgatacgagctcctggcagagcaacgatcaccttgatacctggcttgacatttggagcaccgcaaacaatttgcgtgattgcttcgcccacatttacctgacaaatattgaggtgagtatctggaattggctcagcagacacaacctgaccgacaaccaacttagaaaggccagcactcttttgctcaaccccttctacttcaattcctgttgttgacattttttcagacaagtcatggcttgtcgcatcaaagtcaacgagttcttttaaccatttgtaacttactaacatattatcctttctggtgcaaaggccgtttcagtagccaatccacatcaatcttatcaccgaccgcaaattcatgctggccaaatttttcaaatccgtatttggaatagaatttctgagccttgtaattatgttcccaaactcccagccagacccaatcacaactagactgctctgctttttccaaagcaaattcaaacaagaccttcccaagaccgcgaccttgataggcctgcaagagatagatacgctggatttcaaaggcattttccaactcttgctccgtctgggcagaacctttgttgagcttgagataaccagctatctgatgatctattcttagaaaatagtgctggcagttgggatccgataactcactagtcaagacctccaaggaataagattcctcaaagaatgcctccagttccttcgggtcattatcgtgagcgaaggtctctgcaaaagtctgcttggccaactcctgcaaaacggaaacctcttccaaacgtataggatcaatctgcatctcattgcctctcatttctaactggactaggaaagtcgcagagcaacgatacccacaccttaaatagtgcgagattacgacggttcaaggttgaaaacgacatatttttcaaccttgaacctagtgaggggagtaggtagaccgccatagcggctaccgtcctgtttctagatactttcagtatcagaaacaggtctcacatcaaaactgctccgagaatcgtacatcaccttgatagaaaccacggatgtcgttgataccgtaacggagcatggcaatgcgttcctgaccaagaccgaaggcaaagccagagtacttggttgagtcaataccactcatttccaatacttgcgggtggaccatgccggcaccgaggatttcaatccagcctgttttcttacatacattacaaccgtcaccaccgcacttgaagcaggaaacatccacctcaacagaaggctcagtgaatgggaagtatgatggacgcaggcgaatctgacgctcttcaccaaacattttcttgataatcatttcaagcgtacctttgagatcgcccatggatacattttcaccgacaaccaagccttcaatctggtggaactggtggctgtgggtcgcatcatccgtatcacgacggaaaacacgtcctggcgaaatcatcttcaaagcaccttttgagaaatcatgctggtccatggtacgcgcctgaacaggcgacgtatgggtcctcataaggatttcttctgtgatgtagaaggtatcttgcatatcacgggctggatgatctttcggcaaattcatcctctcaaagttgtagtagtctttttccacttcaaatccgtcaacgatttggaagcccatgcccaagaaaatatcttcaatttcttcagaagtttgggtcaagacatggcgttttccgaccttaacctgacgacctggcaaggtcacatcaatggtttcggaagctagttgttgctgaatttttgctgctgcaaccttttgagcagtttcttcaaaggcagttgtcagcacatcacgcacttcattaacctgtttaccaacgattggtttcatgtcgttagacaggtctttcaagcctttcaataagtccgtcaaagacccttttttacccaaaaccgcaacacgcaggtcttgtagttctttttctccttggtgctggatttcttttaacttttctagtgtcgtttggcttaattcagccaactgttgttcaatgtttgacataattcctccaataaaaaacgcatgacaccactcgtatcggagcgttgtcacgcggtaccatccgttttcatctgcaaggcagaccttagttctatgaacctatattcacaagtgaagtgcttgcacataagagatggttttccgctaatcaaggctgttttttgagggaatactgactgtattttgaaaaaaactaacgatgagtagctgaaaaactagccttagatggaagtgttgaactgtgaatgcaggttctaagtccttgtgtgagtgaattcgaccaactttcactgattgagcttgcagtcacggctcaactccctggacagcttccataaggtgtactagtctcacagacttctattcaattaaggatattttatcaaaaagaagaaagtttggcaagaaatcttcctagaaaactccctctatctaggatagaaaggagtttagttttatagttttgcctgccatttattggcccaaacattctcatttggcacaccaaagaatgcgtcttttccttctaatttatcaagtaaggattcgatagtatttttattgtgatggtaggcattgatagcagttttgaccatggtaacatcgtgaaggtgagttgtatagtttagtgaaatgaaaatggttggaacttcatgtacataccaaggaacttcatttgacatggccgttttccactggatgcggtaattattctgcgctccatatccaatgacattggcaacagtcaaggctaaatcaacttcttctcggtattgcagcgtttttcctttgatccgagtcgtaccatcattgacggtcacttcatagccacgcgcttccaaggcagctttaaggttatcaaccacttctgtacttgccgccataatcccttctttttcaccttctaggtaatacaatcggattctgcgatgggtttctggactgattggaagatttttctgtgtatctttcaacagcgtaattgccttgtctgccgcctcacgttgccaagccaagtgttcttcacagccgataatagccaattcatcagctgattttagtaaggttccttccgcttgcttgatatgcagattgagtttggctttcagacctaaaatgcgacggagagcatcatgaaggcgttcgtcagtaatcactcccttgcggtagccattgagcataaattcaaaatcttcttctaagttattgaagaataagaacatatcgcaacccgcagcaatggctgcaggtacgtagtcttcacgacgcatggctgctgtcatccccaacatgtggctggcatctgttatgaccaagccattgaattccagtttttctttcaataaatcttggatcaattcaggagccagcgttgcaggcaaaatatcttcgtccgtcaaacttggattgagtcgttgttggtaatatggcaaggctatatgtcccgccataatcatctcaacaccagcttcaatatgatgacgatagacacgaccaaagctcttgtcccattcttctggagagagctcattgacgcctaggactaggtgctgatcacgttcttctttaccatctcctgggaaatgcttgatacattgaataacatctctttcagcagtcaatccttctaaataggcactggtataggtaataacatcatccgcatttgtaccgtaggctctggtattgacgatagtattgcgccagttctgaacaatgtccacgcaaggatcaaaattgacatttacacctaatgcagtctcctcacgcgcagatacgagacctgctaggtagggaatacgaggatcccgactggcttccgattgagcacctgaggaaatataggttcctcctttcacagctccatctccacctgagtcacagttcgctgcaaccaagagaggtacttttgaatagctttgcagctcgttaatcagtccttgtacctgttctggactgccattcatataacgggcaccacctatgtggtatcgattcatcaattcctgattactcagattatttccgctaaaagcgtctcctccgaagaagaatagattaacaaacaattgaccgattttttcttcatcagtcagatgagccaaggtattttctacccaggtaatctgctcatcattcaaacaatagggtttcttccgcaaatcaaccaatctaggcattctttcctccttattttccgcgccaaatctgtgtatctaccaagccacagtaggcatcaacaggcgatactcctgtaaaggctgactctcctgctagtttagcaaccaaggcttctaatgtgacaggcaagccatcgtaggcattgatataggttgcaacctgtggcatatctgcaagtgcaaatgggtgctgaacagagacaataatggttggaatttcgtgaacatagaaaggctggtctggtgttcccttggcagctggccaaataattcgctgagttgttcctcctgagttgacatcaactaaattgataatcaaatcatagttatctgtgatttccgcaattggacgcttggaagcatagacatttgcaatcgctgctggtctttcttcttctggcaatttggcaatccgtgcctccgtattttcccagatagatacttggtgacctcgagcttctaatagttctttcagcgtatcggctgctctcttcttgccagcattgatcatggcaccaaaaccacccttatagccatctacttcgaccaacaaaatacgtttgtagcgttctggattgactgggaaaattccttcttgtttggcttttaccaaggtaatcgccttgtcagctacttcttttgcaagctgtttcgcctcatctctaccaatcaaagccagtgcttcttcttttggcaacatgatttcctgacgacgaccttcaaacaagtgaagaccgagtttagctttcaagcccaaggtacgacgaagggcatcatggaggcgttcctcagaaagcagaccattttccaatccttctttcatccattgcaaatcttcttctggatcgttgaagaaaaggaaaagatcacatcctgcctcaatagctgtaggcaatagctcacgacgcggcatagaggctgtcataccgatcatgtgactggcatccgtgacaatggcaccattgtaacctaactctccacgaagcaattcatccaagagggttttattcagcgaagctggcaacatgtcatccaattcacgttctggatgcatttctttctcaacatttggcaaatgaatgtgccccgccataatacctgggagacctgcgtcagccatctcaccataaatccgtccaaatgtttccatccattcagacttggtcatgggattcgaagcgaaagacaaatgatgatctcgttcgtcaataccatctccaggaaaatgcttagcaaacggcacaatgccatgttccataatgcctcgcatgtattctttggacaattcaatgacttggtctacattagctccccatgttcggtttgcaatgattggattgcgccaattacggcttaggtccataatcggtgcaaaggaggcattgcagcctaccgcagctgcttcaagtcctgcaactttccccatttcataagcatagcggggatcggttgtcgcagcaatcttgatttcatccccaattttcgttccatccgtaacagcgccatttccaccagattcggtattggctgcaatcaagaggggaatcttagacttggtctgcaaaatatagttttgctcccaaatatctgcagcaggtccaggattgtaacgaacagcagcaatcttataatcatttaatactccagtcagatagtcttctgtccgctggctccccatgttgacaaagaggtgaccgattttttcatccaaggtcatctgagcaatggtttcttcaatccaagaaatagcctcttcatcaaggctgtaaggtttcttccgtaaatctactaaatgtgtcatgtttgcctccaaaaaagctagagggcatagcgcctctagcccttctctagtcgtctaaattattccaaaatgcctgtatcaattctgtttctttctcacctgtgaatgcttgatgagcaaagtcatctgcaatcgtttctgtcaaatctgcccaagattgcatctctcgtcctactaaaataggatagaaatggacaccattcaattccgccgccttcaaatcaccaggcgagtcaccaatcatcataatcttattaggacaatacccttcctctattaacagtttgatgacatcttctttcttgccacggtcttgacagtacaattctgtaacaaagtccatcaaaccttggtctgtccactcttcttctactgcttccttattagcagaagaaactacgtagacttttcctaactggctcaatttttccaagcccttgtgaacgccgatgaaggctaaaacaggaccactataatgcttaatggcttgattgacttgagtggaccattttaaggctaattccaagtcttttgacggctgctcctctatcaatctttccagagaagcatttgacaaagaatctgtggtcgcgacccaatttttcaagttgtctataccagtcacacctgcaaattctaggcctttaactaagccaacaaaacggttaatgccacgttctcgtgagtagagattaactcgattccattcagctaaaaacggttctttatcttcaacaccaaaaacttccgcagctaaggggccgaagaaaagcttatgtttgtaggtcatggtgtccatggcgcagccatcagagtccacacaaaatacgtattccatcttcatcatcagactcctgaataggctgagaagccaccgtcaatcggtaaaacaacaccgttgacaaaacttgccaaattctcatctgccaagaagaagacgccgccgactagctcttccgattcaccaaaccgtcccattggtgtattggtcaaaatcttgttggcacgtgcggtcggttgacctgactcgtcaaaaagcaaaccacggttttggttggttaccaaaaatcccggagcaatggcgttgcaacgaatactaacttttgaaaaatgtactgccaaccattgggtaaaattactgatggcagccttagcacctgaataggcaggaatttttgtcaaaggagtaaaggcattcatgctggagatattgataatatttgctccgctacggccaatcatatcctgtgcaaagacctgtgttggcaataaggttcctagataattcagattgaaaacaaagttaatccccgcctcatctaggtcaaagaaggttttcgtatccgctggaagacccacttcatggaactcattatccgttgtcgctttcggattattgccacctgctccgttgattaaaatatctaccggaccgaaatctgccaatacctgttggcgaacttcttccaaattttccttggaaaggacattagatttgtaagccttggcactacctcctgctgcaacaatctcatcaacaaaaacttgggctgctgcttgatttaagtctaaaagagccaccttggcaccagccttagcaaattccttggctaaataaccacaaagtactccgcctgctcctgtaatgacaacaaccttgtccttaaattcaatgacacgcgtcatagttatccctcctttgttccaactgtttttgctttaataccaaaatctggtgttttgccagccgctcgcatattggcttcgtatagaccattaaagtaagtcgccccgagcgctcggtcatacagaccgtagcccggtgtcttggtctgatctccccagatacgacgaccatgatctggacgcaaagaaccttgccaatcatagtccaccaataatttaacaacagcattcatatcaatgtcaccagcctgtgacaaatgtgcagtttcttggaagccccaagcacctgccgtcacattgcgcgtatgcataaaattgatacgattgcgtttgagagcatattccgtcatggcaaggacatcatttttcggatcagaagcataggatccgacacacatggtaattccattgtgttctgaatcatagagattcaaaaatcgttcaacggcttcttgaccagtaataatacgtggcaatccgaaaattccatacggagggtcatcagggtgaatggccattttgacgccagcctcctcagccgttggcagaatcgctttgataaaatactccaaattcgcccataaatcttcttcagagatattctgacgataattttcaataatagccttcatttcttccttggaataggacgaatcccaacctggtaagttcaaatcatccgccacaggatcaacacctgctaaatcagattttaggaaagctaaagaggttgaaccatccggaagtgggtggtgcaagtctgaacgggtccagtcaaacacaggcatgaaattgtagcaaacaactggaatacctgcagccccgacattacggatggaagtcttatagttttcgattaaggcatcacgatttggcttcccttgtttgatgtcttcatgaacaggaatggattcaataacagtaatttcaagtcctgcctcttctaccatttttttcagctctagaatgttttcaaggggccatgcctgaccaactggtacatcgtagactgccgttacgattccctgcataccagggattgctttaatctcttccagtgtcacaggatcttttttcccgtaccagcgaaatgacattttcatgatttactctccttctattgttcaaaaaactctttggcattgtaataggatatggcttctacaaattgccctaaacgattgtaatcttctggcacttcttcatcaacaatccattgaccaacataggtcgctaaaatgcgtctgaaataatcatgccgttgataagataaaaagctacgcgaatctgtcaacataccaacgaaattggcaagcatgccctgttctgcataagcattcatctggtcaatcatgcccaactttgtatcattgaaccaccaaccagcaccaaattgtagctgactacgaaccccttcctcattggactggaaattcgccaaagtattggccagagcaatgttgtaacttggattgagattgtaccaaatcatttttggaagggcattttccttgaccaagttatctaagaaacgattcaaattcacagtcagacatgtctggtctccaatcgaatccacacctacatctgctccaagtttttcaaacagtccggtatggttattccgtaaggcaccgaagtgaacttgtgtcacaaagccatgtttcttgtacaatcggcacaattctctaaagatagcagtctgccatttattgatactggattgaccagcttctttacctgcaagtcttgctagtaaaatttcatccaactcttcgagggtagcctcttcataggaaatagccgtaaaactgatgtcacttgctcggcaaccgtgttgagcaaaataggaaacacgctgaccaagtgcctctacaaaacttgcaaagtctcttactgctacccctgttacctcctccaagcgtttaataaatggattgaaatttcgatgttctataaaagcttcatctggtcggaaagtcggtgccactacagtatctatggtcgagtcctcagccaagcgcttatgccattccaagctatcaagaggatggtcagttgtcccaataaaggtcaccctaacatccgcaatcagcttccgtggactaacttgatgttcttgcaaataagcattgagctgatgatagagtcgctctgcattttcttcggtcaacaattcctcaacaccgaaaacctgtcgcaattccaaatgactccaatgatagagaggatttccgaaagcccgttccaaggttcttgcccaggccttaaacttatctagtttacttgctgaacctgtgatttcttcttctgagataccattagcccgcatcaagcgccacttataatggtcaccccccagccacaaatcaacaatatcttcataaaccttatcttcaaaaatttccttcggatccagatgacaatggaaatcatagataggaagctctgctattttcccgtaaagctccttagcaggctcgttttttagcataaagtttttgtcattaaaactcatttcatccctccaaagctgcaacaaaactgcgagcaatcgtcgttacactttcatagccttcagcctgcactcgacttgccagagccgaaccgactccaacagcacaagcacctgcctttttccaatctgcaacattttcaaccgaaactccacctgaaggcatcaaattcacatcaggaacagggccgtgaatatccttgataaatccaggacccaagacaccaccagggaaaagcttgataataggacatcccgcctgactagctgtgacaatctctgttgcagttgcacaacctgggaagtagaatacctcagcctcttgcgccaagtcttgaatttctttatcaaaatgaggactaaccaggaaactagcacctgcatcaatggccgcttgtgccagcttaagattcatcactgttcccgccccaatgactacggatgaatcatctgagaactcctcttgtaattctttgataactgtcgctgcatttggagtcgaaaatgtaatttcaatatttcgaatacctcccaaaatcgcatggcgagcgatctctttcgcatcttcttcatcttttccgcgaatcactgcgaaaaagtaattttcttttaattgctttaacatcttgacctccaattagaaagcgttgtcatttatagctatagtatacaattcatcagatgatttgtcaataaaaaagcaaaaaatacccagaagaattcttctgggctgtctattttttatttctatttatgatcgttgagaccatgcaaggtcatatctttatcgaaccattcgcttaaaacaacctgtcttactgatataatatgtgctaacatgctatcatatgctgcaacagggtgacgttgcttgatagccattaagatattcctgtgggcctgtaaactatccgatttcatctgacgatttgaatagttttcattgattagatgaatagattgattaatgacaggcatgagacttgtcatagccagattcccactcatctcagccagcatacagtggaattttacatccaactccagatgcttcgtgtctccagcagcaacagcctcttcaatagcaaggacaatttcttctagtcgagcaatgtcttcgtccgaggcaaactgagcgacacgctccgcaattctcggttcaagtaaataccgcacttcaaacaaatctgtcgtcaacttcacacggtctcttaccaaagaaaaacctaggggatcctctgatactccttttttagagctgatataggttcccgacccttggcgcacctccagaatatttcgagtagccaaacttcgcacagcttcacgaacagtcgaacgtccaacttctaaatcttgggccaattcatactcatttggaagcttatcaccaacttcatatcctctttccaaaatcaattccaataagcgctctgatgctttttctaccaagggtttcgccatgtgcttggtcctccaatacaactttctatttgctactattatagctcatttcctcttataatggtagtttggaatggcagtccaacgtttcttgatttctcttacaatttgcttgggttgtctatttcttgagaataatcctttgtgatttccttgaatgcgaatgataccgactgtagtttcaaaatcagcaaaattccatacctgctcaccaactaaattcggaattgaatcaaagacgcaatggttcatatcgtagtaatccacctgaaattcctctgtataaggaatatcccacatcgaatgcaaacctggaagagtatctgcaccatattccgtaatcaaaatcggcttgtcaggataaagtttttgccaagtctccaactcttgacggagccctttctctgccgccttcaagtcaccatgagcaacataccaaccatagtaacgattgagacagacaacatcgaccaaatccataacctcatccttatcaggcgttgctgtcataatattgaccaaggtcacaggacgcttagacggatctctgtccctcatgcgctgaatcagaggttcaaagtaagcacgtgctcccttttcatgccctgccggttcattggcaacaacccacatcactacagaaggatgattcttatcacgcgctatcaattcatcaatcaccagctcatgagcctccttggtttgcataacttcccaagtattttttgcttcttcagaatcccctgtcaaattcaaggctgcattgaaaagctggaacaggccaactgctggcacttcatcaaggacgacaattcccaaacgatctgccagccgcatcatttcctcagaatagggataatgagatgtcctaaaggaatttgctccaatatctttaagcaaattcaaatccatcagattggctgcttcattgaaaccacgcccattgatgaaggtatcttcatgtttaccaaatcccttgaaatagaaaggttttccattgatgaaaaactgcccattttcaaccgcaacactacgaatgccgaattgttctgagtaggtatcgagtaagttttctccgtcaactaattcaactttagcagtatagagataggcatccaagacctcccaaaggcgtggatgttcaatgaccatttgtccattttcaagaagacctacttcctgtccctcttgatctaaaatagacatacggatggaatcgtactgcccaactgtcttcacatcaacattcactaccgcctgagtcaaatcttgatttagctccgtccgaataacaatatcctcaatcctattttggggacgtttatagagatgaactgtccgctggataccagcatagttgaaaaagtcaaaattttccttgacggtcttcacaatttgaccattctcatccacttcttcgctataattccctactgggagggttgtgtaattcaactcattattagcacaaaccgtcaaacggaattgatcagcgtcgtataagtttgacggaatcaagcattcaaaaggtgtgaaaccacccttgtgctccctgattaactgaccatctgcatagactttagcctgatgtgtcaccgaaccaaagcgtacaactaactcttcatcatcagctactactggaagagctaccatcagttcataccaattatctccgacaaaacgacgtttgtccttatcaacaacaacatcattaaaagaactcggtacaaccattacctcatctgtatctaacagagtatgaacatcattgttcccttgcttaaatttccatattccatttaaagaataaactgagcgtgtttttgtctgtattggatacaacatactttttccttctttctatcgttttatttcacgtgacccttttttcaatagcaaagcaatatctgacggactgatgacattgacatcaccttcaatggtatgtttgaattgaaaactagccatccccaagtcgactatttcctgtggcgttttttcctgcaaatagcccaaaataattcctgctgtaaaggcatcccctgtcccaactcggtccaaaacttgaatggattctttttccgtttcataaagaataccatcttgatacaaatatgctttcagcaaatattcattattgtaggtcatttccctctgggtaaaagcaagactttgcaaagaatacgtctccgccagacctttaaccaccgccaacaagacttctttattttcataagggcgcttcaaccccaattcatccttcacatcttttccagattcattgaagagttgaataggctctagaccaaagcaaatatctgctaaacctacaaaaggagataatttctccctcgcttcttcaaaagaagaccacaaactttctcgataattcaagtcaaaagaaaccttaacaccctgcctctttgccatttccatcaaacgaaaggccagtcgataaatatctggattcaaagcgaccgttataccactgacatgaaaccaatcgacaccgtcaaacataccttccaaatcatactcttcttccttggataagctaaaggcagaataatcacggtcgtaggtcacctggctaggtctaagagagaagcccttttgataataataaatccccagccttcctttttttcgaatcagatgcttctgtccaatctgccgtgcaaagagaaagtgttctgccatctttcccacttcattttcaggaagtgccgtcaccaactcaactgaatgccccaactgtgctaaactggccaagacattcaactctgagccaccaaactgacaatctaaactggtagcttgtgttagggtctgataatgaggaggagatagccgcaataaaacttctccaaacgctaagatttttttcataccgcctcctagatgaaagacccagctggaatcctccaactaggtcgttattgtattatttatcgtcgtattgatcaaccttatattgagtaacatctacataatccatatcagataatggaacatttttcgcaatcgcacgcacacgttcctcatcttttgccgctttcataacatggattttctcttgaatacgtgccatttcttcacgatctagtttgtaaaatttcatcaagaacaaggatacgctcaataccactgctggaatcactgtcaataggacaatcaaagccattctcaaatctgttgagaatgctgtttcaacggttgggtactctttaccaaaaccaatacctgctaatacaaatccaacaaccattggggcaaatgaagaagcaattgagtctgtcaatgagaagatagtcccaatcatacctgacaagtaacgaccagatactgaagtttcatagtctgtaatatctgcccccattgtcaataccaaaccagatggagcactagatgcgtagcgagcaatgatataaacaacaaagaagccgattgtgtagagattccaatttgtcaaatccaacatacctggtttagctgaaaagagcatcgctgccaaggtcacaagaccagcaatcccaagttgaagcgctgtaatataggcaaagcgtaaacctttacgacgagccaattgcgcagcaccaactgttacaagaatacctggcaaaatcaacagcatagacattttaccagaaagagcatagtcaccgaagataataccatacagcataaccctgataacggaatctccaaacagttgagcaacaaattttacaaaagctgcagagattgaaagaacctgcaaaggtttgtttcctttgataactttccagtagtctttcaacttagtttcttgtgtcttctcaccaagaccaaagtatttcttattgtctttctcccaaataccgataatagcaagaatacccagaacagctgaaattactactacaccgaggaacaattcttggaagaaacttcgagtgaaaccaccatgttttggaaccaatgtccctgacacaacaacctgactaccagtcatcaacacagttgtcgcaataccatcaacaatattaaagattggacgttgctttggatcattggtaagcgcaacttgtcctgcttttgtaatcgtctgttgaagtgaatatccaattttatggataatcaaaacaaggatgaatagaggaagacggagactctcgctaactccacttaaacctaacatcataaaaagagaagctgctgtaatgatattccccaaaaccaaaataggacgatatttaccaaacttagtatccgttttatcaatgataactccgattgtaggatcaatgaaaccatcaaagatacgaatataccccatcagttgactaacaaacagggctgcaagaccaagcacacctgtcgataaataagtcacgaaagtaaaagcaaccaagtaaatattcgtcgatgaattgttcatcgcaaataatatgatttgccataacttggctttgttataagtaacgtcttcgacacgttgctcaacatgtttttccattggaaattcctcctaaatgttttctacgacaaagtcgtaagcgttttctttaactatattctaatattcatcagatgatttatcaactgtttttgtaaatatttttaattatacgcaaaaaaagacgattttacgtgaaaatcgtctgatatatttgatttaacgagggagaattcgtctgactatttattgatttactgcaatttccccactatgatagttgatactgagaccactctgcacatttggaacgaacacattgaactctaggctaccatctgctgcttttgcctctagatgacttccgacaggaacaaggtcttcactctcagcatacaccaaggtcacacgatagcggacacgcttatttttatccaaggcccgccgaatctgactttcaaaataattctgcccagttgaagtttggtcgttagcttggttggaccaagctgtttgaactgcaatattcttaggattgctggttgaagcatcgaagccagacaatccaccaatcaaagcataacctaggaggtgaccacggtccactgcatggtcatattctccagttaaatcatggatctgatgccaacccgcaggtgtccaagaagttcgaccatttcctgtttcttcacgatccttatactgacgtgtagatttagctaaaagcgcattggctactgttggaaccgtttctccctggactgtttttgtcttattatcaccataaggaacactggcaaccgatgcatctaaatccgtttgattcccgttaataataaacgctccagcactattccattcaatcgaatttcccagttgcttttttacatcttctgtcaataccgaactagccagttcctgattaggtgtgccttcacttgccttagactgattgacataataggaataatcagcaacgttgctactcttgttatcacttaaaagatagccacccgctactacaacaatcgtagccaataagctgagcagactcattgcttgtttttttacatttttcttcgccattttctctccatcaaaaaagcaggtccagcctactttcctgtaaatttaccgattaattcttgccacttagctggtgacaacaccgcaaatacattgtctccatctcctatgacaccgtaaccaaccattaatcctaaaataaacaccaaaatagcaatcaacaaaacaactgctactaagattaaatttttaccaacatagctaagattatccttatccattttcatcttctccactcacacgttcaatcgttgcacctaaagcagctaatttctcatgaaaacgatagtaacctcgatctaagtgcgttaatttacctacaatcgtttcaccttcagcgaccaaaccagccagaatcaaagcggcacttgctcgtaaatcagtagacataacctgagcaccttgcagagcaagtcctcccgtgatgatagctgtatctcgtaaaatttccgaatgcaaatccatccgacgcatttcttccaaatgctggaaacgattctcaaataccgtttcaatcatggtagattcaccctttgcaactgccattagagctgtaaattgagcctgcatatccgttgggaatcctggatggggcaaggtttttactgttacaggtttaagcttatccacttgcgaacgaactcgaatcccttcagcttcttccgtcacctcaactcccatttccaacatcttagaaatgagtggacggttatgctcccagacagcgtccttgaccaagacatctccaccagtcattgccgctgccaccataaaggtacccgcttcgatacgatcttgcaccacttgatgttctgcgccagtcaattcttctacaccagtaatcgtaatcgtctctgtacctgcccccttaacttttgcccccattttgtttaggaaaatagccaagtcaacaatttcaggttctcgcgctgcattttctaataccgttgtaccctgcgccagagttgcagccatcatcaaattttgcgttgccccaacacttgggaaatcaagatagatatgagctccctgcaagttctctgcactcgcttcaatataaccagcgcgttgtttaattttagcccccatagcttgcaaaccttttaagtgcaaatcaattggacgactaccaattgtacaacctcctggcatagaaaccttagcatagccattgcgtgccaaaatcggaccaagaataacaatagaggcgcgcatttgactcacatacttataaggagtttcactaccaagtttacctgttgcatcaatatcgatagtctttgtttcctcgtcaaatttcacacgaactcccagaccacgtacaacattattcattgtatagacatcagacaaaataggaacctgggtcaatttggtttgcccttgacttgctagaactgttgctgccaataaaggcagaacggcattcttcgccccctcaatctcaacctgtcctttcaaaccgtttttactacctgtaataataattgtatccatttcttatccttttcttacttaaatcacatatttgcaaaagagcgtcccatcatcaacaattctaaaaagaaagtcgagactaagtaccccagtgctattgccagaaagagaatcagcaaattgattttacgctgattgtccccagtcaccttcaaccaccgtgaccaatcaactgttgtaaccaagagatgatgagccagatagataaacaatatatgactaaaaaactgtaaaattgaaattaccatgtttccattataccatgaaattaaaaaatggaactgaaccaagttcaatcccatatagattaatgtttcccaacacgaatacgatttatcgcacgttggagggcgactgttgcacgcatttccatatcaatattacgagcagtctgtgcttcttccaattcacgttccgcgcgcaatttggcacgttccgcacgactaatatcaatatcccgttcccgctcagcggaatcagaaatgaccgtaataatatccttgttgacttcaatgattccaccattgaccgcaatccagtctacatggttttcatcatcaacacgacgcactttcatttcaccgatttccaaaactgcaatcagttcttcatgtccagaatagacacccatctcaccatcaaccgttttgaccaaaacaaatgctgcatgatggtcatatttgataccgtctggtgttacgatttgtacagtcatttgtcccataagccacctctagaatttcattttagcagctttagcgaccacatcctcaattgaaccaacatttcggaaggcatcttctggtagatggtcgtgtttgccgtccaagatttccttaaagcctttcaccgtttcagctactggcacataagaacctggcatacctgtaaattgctccgcaacgttgaagttttgagagaggaagaattggatacgacgagcgcgaccaaccaaggtcttctcttcatctgataattcatccataccgagaatggcaataatatcttgcaattcttggtaacgttgaaggacacgttttacttccatagctactgcatagtgctcttcaccaacgatttgtggagcaagtgcacgtgatgacgaagccaatggatccaccgcagggtagataccaagctgagtcaacttacgctccaagttagttgttgaatccaagtgagcgaaggctgtcgctggagctgggtctgtatagtcatccgcaggtacgtaaatagcctgaatagatgtaacagaacccttcttggttgaggtaatacgctcctgcaattgtcccatctccgtcgcaagtgttggctgataaccaacggctgatggcatacgacccaagagggcagacacttctgaaccagcctgtgtgaaacggaagatattatcgatgaacagaagaacatcctgcccttccacatcacggaagtattccgcaatagtcaaaccagtaagagcaacacgcatacgggctcctggtggctcattcatctgaccaaataccatggccgttttttcaataacacctgattctttcatttcccagtaaagatcgttcccttcacgggtacgctcgccaactccggtaaatacagagataccaccgtgttcttgggcaatattgtgaatcaattcttggataagaacggttttaccaacaccagcaccaccgaagagaccaaccttaccaccttttagataaggtgctaggaggtcgataaccttaatccctgtttccaaaatttcgcttgaagtagataattcgtcaaaagccggcgctttcttatggataggctcacgttcaaaatctgccggaaaagactcttcaaggtcaatggtatctcccaacacattgaagacacgacccagcgtttctttaccgactggaacagagatgggacgacctgtatcgagaacttccatcccacgtgtcaatccatccgttgattccatggcaatggtccgtacaacgccatcaccaagttccaaagccacttcaagcacgactttttgtttggaatcatcatttttatatacaacgagtgcgttgttaatctcaggaagtttatcttctgctgcaaacgcaacgtctacaactggtccgacaacctgagtaattttgcctgaactcattctatttcctctatttctattactcaagggctgaggcaccagctacaatctcagtaatttcctgagtaatcgctgcctgacgagccctattgtattggattgtcaaatcgttaatgacattcttagcattatccgttgctgtctgcatggctgtcatacctgctgcattttcagcagttttggcatccaaaatcgctccataaatagttgattctgcatattgagtcaagagttgttccaaaataacctcacggtttggttccaactcaaaggtagctgtataaccatctgcttcattgtggtccaaatcttctacaggaagcatctgttgtacacgcacctgactggtcaaactattgacatggtggttataacaaacatacaactcatcaaagagttcattcttgtacatttcaacagacttagaaatgattttttgaacctcttcaaaacttgggttgtctgctaaacctcgcaattcaaagacaggattgataccacgggcacggaagaaatcagctcccatactaccaatggcaataatctcatactcgtcttttgagtcatgatcctgttcaatcatccccatcacagccttcaaaatactggaattataagaaccttttagtccactgtcagaggtaatgacaatataaccagatttttgaactggacgacgaatcagcattggattgcttgtatctgaagccatcaactctccacgcaagaggtccgttgtaatctgacgaaccttgctagcgtagatttgaaaggattgcgctaattgctctgatttggctaatttagaagccgaaaccatctgcatggcaccggtgatttgactggttttcttagttgatgcaatttttgatttgatttcattgagagaacctgccattattcactcctttacttaaagacagactggtctttgaaagcttggatagcagcattcaattcatctgtatcaggaagatcttttgttgtacgaataacatccaaaagaccatcgtagtgcaaatcaaaatatgcgtacagttcttcttcaaatgccaaaatatcatcgattggcactgaatccaagaagccatttgtcaaagcatacaaaatcaaaacctgtttttcaactggaagcggcttatgcaatggttgtttcaacacttccacagtccgacgaccacggttgagtttagcctgagttgctgcatccaaatccgaaccaaattgagtaaaggcttctaattcacgataagaagctaagtcgatacgaagggtacctgcaacctttttcatggccttaatctgtgcagagccacctacacgtgatacagaagaacccgcatcaatggctggacggataccagagttgaataaatcgtccttcaagaagatttgtccgtccgtgatagaaatcacgttggtcgcgatgtaagctgaaatatctcccgcctgtgtttcgataaatggtagagctgtaatggagccaccgcccaattcatctgaaacctttgctgaacgctcaagcaaacgactgtgcaagtagaatacatcccctggataggcttcacgacctggaggacgacgaagcaagagagataattcacggtaagctaccgcttgtttcgacaaatcatcgtaaacaatcaagacgtgtttgccttcatacatgaactcttctgccatcgcaacaccagcataaggagccaagaaaagcaatggagacggttgtgaagcagatgcagttactacgattgtgtaatccaaagcaccatattgacgaagggtttcaacctgagtacgaacagttgactctttctgaccgatagccacatagatacaaatcatgtcttggcctttttggttgagaatagcatcaatagctacagatgtcttccctgtctgacggtcaccaataatcaattcacgctgaccacgaccaatcggaaccaaagcgtcaatcgccttgagaccagtttgaagcggttcattaaccgacttacgttgcataacacctggtgctggatattcaatcggacgagtcttactagtacgaatctcaccaagaccatccacaggttgaccaagtgggttgatgacacgaccaatcaaagccgaaccaactggtacttccataattttaccagtacgacgaacaactgacccttcacgaatatcggtaaattgtccgagaatgataataccaacatcgttggtttctaagttttgtgccataccaatggtgccattttcaaataccaaaagctctccactcatggcattgtcaagaccttgcgcacgggcgataccgtcaccgatataggttacgacaccagtctctgtgtagtcaaagtcaggctgaaagccttcaatttgttgttttagtaaagcgctaatttcttgtgcattaatcaaaagaacaccactttctattttttaaagtttttttctaatgtccttcaactgtgtccgaacgcttgcatcgattaccttatggttaaccgttacaataaaaccaccgaggagactttgatcaagttcttccgtgatattgcgtacacgcaaggaaaatcgttgttctaccaagtgacggagacgctctttttgagcttctgtcaacggatagactgaaaccacacgggcttcaaattcatttttaaatttactgatttgtaattggacacgctcaagggtttcaagaagcaagtctgcatgaccatcacgaataacatcttcaatcaagtcattgatttgccagaaactagattgacgtaccgtccttacaaagtcagccttttcttctctcgatactgtcgctgacagcaagattcgattcagcttactatcatgaatgatggaaatcaagtcagaaatctggtcatacatatcccaaatatctgcatgatcactgactttttcaacaaatgatagagcatatttttgcacgatggcattttctctagcgttcatctacttgtctcctagtttgtccaaataacggtcaatcaagttactatgagcttgttggtccaaatcttccaaaataattttgcttgcaagatcaactgccaattcagcaacttgaacacgcaagttttcttgtgcttcacgtttttcagcttcaatttccaattgagctttttgcttcaatccttgaatttcaacatctgcttgctcaagaatacgttttttctctagttttgcgcgttcaaccgcgtcttgaataatcttttgactttcaatacgtccctgtaccaactcatcttcacgttgttgaacaaggtttgctgctgctgttaatttttcttctgcagcatcaatatcgttcgcaatcttattggcacgttcttcaaaaatacctgtaattttatcccatgcaaaaacacgaataagaataataagtactgcaaatgaggctgttaccaagataaagtttccaagaatggtactagattgcattgtaatagttgttgccatagttgtctttccctttcctattcactctcactactgatttttttatttaagtacatagataccaacatgataaatacatatccctgcaagcatgaaatgaatacagaaaatgctgtccaaacaacgttcagagcaaaggcaattggatatgcaagtgcactttgttgagataattgtagaagaagagagacaagcacttcaccagcataaatgttaccgtacagacgaagagcaagcgacacaaggttggtcacttcttccaaaatgttcattggagccatagcccagggtgtcacaaaagatttgaggtatgccttgaaaccgcgacgacgaataccctcaacatgacaaaatactgttgcaattgttgccaaaccgaaatcgtaagccatattggctgttggagaagtccacaaattatgtccttctgctgtttccaatttggtcatcaaacctagattattggcaaccaaaagaaaagtaaagactgtaaagaagaacaaggaataccgctttgcttccgcatcgccaagattcccttttgtaaaattgatggtcaattcgtaaacatactccaaaacattctgttttccttttggcttgagctccatccgacgactagcccaaaaaactcgtaagaaaataatggaaatggtaatgacagaaaccaataccatggtcaggtcaaaggttacgggaccaagggtaagggttggacttaaatgttcttccaatggaggttccccccttttctatttctctattttctactattttaagacaaatgtcatagccaaggttacgaagaaagttccctcgataaaggcaacacccaaaaatacaccagccatcaatttactttgcatttctggttgacgtgcagtcgaactaaggtatgaagccaccaacagtccctcaccgatacttacaccaagacaggccaatccaagggccaatgcgcctaaactcataacgaattctccttttaaaatttaataccatgtaaggatactcctaaaacatctatttgtcaagaaaataccgccattgtaagcgtttaattcgtttttgtaaaataaaaagaaaagagtatttcatcttttcttcctatttaatagcttcatcaatatggtctgtttcttcaatgaatcgtttggccatatcttctcgattcatctgatcagtatcaagagtgattgcatggtcagaaaccagatctgtatctgcgaaaaactctatatggtttgataggttgtacagacgtacaggggcttccccaccaaactctccatctagattgagcagtagacggttatctgggttcagattttcgatggataggctcttggtttttatgtattcaactaaatcactctcaatgtgtttgccaccatctaagacttgacgaatcagatgtagaatttcaaatagattccctgttttaaccatcaataaggtaaaattaccatcatctaacttagcatcgggaacgatctgttcaaaacctccaattgaattggttaaggcaacaaaaatcattgaaaccgagccttcaaacacgccctcatcatgctctacacgaacaggtgtaaattgtacttgtggcaggagttctgctccttttactacataggccaaatagccaaacatggtcttaagttgactgggaacactgtaggtcaactccgtaagtgtacctgccgcagcaatgttgataaaataatgttcttgatgaaaaccatttttttgatttttggctaaaccaatatccattaaaattgtctgctgcttaccaataaccttagctgcttctacaggatttcccctaggcacttttaaagcacgcgcatagtcattggtggtgccagtcggtatgatggccatctgcggacgtttttcaagtggagcaattccattgacgacttcattgattgttccatctccaccagccgcgataatcaagtcaaagcctgcaagcgccgcacgtgtagcttcattctttgcagagtctttctcagcagttgtttggaaagctgaagtctcataaccgtagccttccaaaatttccaatacttcggccacatttttcttcatgatttcttgacctgaggtcggattatatattagtctagcacgttttctttcttccatcgttttacctttacaagctctctaaccaagcctcatcttttatttcaatacctagctcctgtgctttggtcaatttactgcctgcatctgttccggcaaccacaagattagtttttttagaaacagatcccgctacatttgcccctaaagcttctaatttggctttggcttcgtttcgtttcattcgctccaatttaccagtcagtacaactgtcatacccgatagcgcagcattttcatctactacttggccgagataggttaagtttaccttagcttccttaagttcggctaaaagttgttgcgcaccctcactagcaaaaaaagttgtcaaagacttagcaataacctgaccaagaccttctagcgaagcaattgcttcttgatcagcaaatgctagagtttctaaatcaccaaatttttctactaaaatcttacttgccttactacctacatggcgaatacctagtccaaataggaggcattctgctgagttactcttagaagtttgaatggcttgatagagcttgttagctgatttttctttgaaaccttccaaggtcaataggtcatcaacagttaatttataaatatcagcaacatcgtgtaccaagcctgctccaaagagtttttcaacgattgaagaccctagccctgcgatattcatagcatcccgacttgcaaaatgttccaacttactcatcagctggctaggacaaatagggttgatacagcggagggcaacttcgtcctcatagtgttgtaggtcgctctgacaagacggacaatgactaggaatgggcatgatttcttgctcttttcgatacttgtccaccactttcagaactgctggaataatatctcccgccttataaacaatgaccgtatcgccaatacgaatatctttttcggcgatataatctacgttatgcaaagttgctcgactgacagtcgttcctgccagttgaacaggactaagattggccgttggtgtcacaacacctgttcggccaacagtccaatcaaccgacaagatttctgcttctttttcctcagctggaaacttgtaagctactgcccatcgtggcgctttaactgtaaatcctagttcttcttgtatagctaaatcatttaccttgatgacaacaccatctatctcatagggtaaatcatctctacgctctgctattttttcaataaaatcccacgtgtcatcaatcgactccgccaagcaatattcgtggttggtcacaaatcccagagcatccagtttctccagtacttgtgactgactagtcgcttcagatggactagcctcttggtagaggaaagtagcgagaccacgctgggccaccactcccgtatcaagctggcggagggtccctgctgctgcattacgcggattaacaaattcagcttcaccagcctcctgacgctgtttgttaacacggtcaaaggaagcttttggcatataacactcacctcggacagtgatgtccacagcttcgggtaaggtcaaaggaacatcagccactcgtttgagattttctgtgatattttcaccgacactaccgtcaccacgtgtagcacccacgactaaattacccgcttcataggtcagggaaatagacagaccatcaatcttcaattcacagatatacgttgcttgaggaaattccttgcgaactcgctggtcaaaagcttctaactcttcacgagaaaaggcatcctgcaaactaaaaagaggataaacatgactatatttttcaaatccgtctagcatctttcccccgacccgatgggtaggactatctggtaaaatcagttctggatgagccgtttctagctctactaattcacgataaagcgtatcatattctgcatctgatacgctaggttggtccaattgataatactctttagcgtattgattgagcacgctaactaattctgatattcttgttttcataagaatattatatcatgatttgagggtgcgaactatatttgcgcttcaataaaaacagattcctttagataatttttagtaaaaaatgtataatgtttatataaaatttttggaggtgccctatggctgtaacttataaacgacaagatgatttagaaaagatgctggaagaatttgcttcatttgaaaaattggaagaaattgagtatccagatccaaaatcaaaagaacattccgagaaaaacaacttgaatcaggataaaaaataatatgcttggtcttgatcaattacctacctccgtcctacaggcgggggctattttcctatctatcatgattgaagccttgccctttgtcttgattggagctattatttcaggttttatcgatgtgtttataacaccagataaggttcgtaaactcttacctaaaaacaagtttcttgccattctatttggaacctttatcggcttcatttttccgtcttgcgaatgtggtattgtccctattgtcaatcggctattagagaaaaaagtgccgagttatactgctgttccctttttagtaacggcgcctgtgattaatcctatcgtcctttttgcaacctttaccgcttttggaaattccctacttttcgcactctatagagccctaggagccatcattgtatccctagtattgggaatcattcttggttttttcgtaaaaggaccaattcttaaaggaagcaagtttgaccatcaccagcatgattattcagataaaaccagctggcaaaaagttggcttcgcacttattcatgccattgatgaattttttgatacgggacgttacctagtctttggttgtctatttgccagtctcgtacaagtctatattccaaccgctgtcctgactaccatcggtcacagtccattaacagctattttactgatgatgttgctggcctttcttctttccctatgttccgaagccgatgcctttattggtgcatcactactatccagcttcggattcgccccagtaatggctttcttagttatcggacccatggtggatgttaaaaacttgctcatgatgaaacattatttcaaagggaaatttatagtcggttttatcattactatcactctcgttattttgggatatagtctgatacttggaggtgtagtatgattcgttttttaattcttgcaggttactttgaaatgaccatgtatctttatatctctggaaaattagaccaatacattaatctgcactatagctatctagcctatctatccatggttttatctttcatacttgccatcgtacaattgtatgtctgggtaaaagaaattcgagtacatagccatttaaaaagcaaaattgccaaactatcaagcattggactattgctcattcctcttgctatagcctggctctttcctacggtaagcctggattcaacaactgttgctgccaagggctatcatttcccactagcaacagaaaacgatactaatacacaaaaccaagaaggggcgactgttcagtatctcaagcctgatacttctatttattttacaaaatctgcctatcaaaaccagatgcgtgaaattgctgatagatacttggctgaagaaaccattgtcgttactaatgaaaactatatggaagtgatggaagcaatctacgactatcctacggaattttcaggaaaaacgattgaaatgattggatttgtctacaatgaccctgacaatagccagcaatttttccttttccgctttggtattattcactgcattgctgattctggggtatatggcttactctctacgggggctaccacagaatttcctaacaatacttgggtaaaagccagaggaacaatcaaggtttcctaccacacatcgttgaaacaaaatctcccaacacttgaattacaatcgatggttcagattgagcagccagattctccgtatgtctaccgtgttttctaataattccaactaaaaaagtgaattttctgacaatttgtggtatactattaatgatattcaacagataggaatgaaattatgtcatcacatgtattgtttacaatttttggtgctagtggcgaccttgccaaacgcaaactctatccatccctcttccgtctttataaggcaggccatatccgagaaaattttgcagtaattggtacagctcgcagaccctggaccaaggaattttttgagcaaaccgtcattgaatcactaggtgatctgcctgacacaccacgtcaagctcatgaatttgcaaatcatttctactaccaaagccacgatgtcaatgacacggaacattatgtagctcttcgtaaattgcaggacgacttgtgtgaaaaatacaatacccagcacaacaaggtcttcttcctctctatggcacctgaatttttcggaaccattgccaaacacctcaaatctgagcaaatcgttgatggacaaggttttgaacgcttgataattgaaaaacctttcggaactagccttgctacagctaccaaactcaatgatgaattggcagcagccttcaatgaagaccaaatctaccgtatcgaccattacctaggcaaggaaatggtgcaaaatatctttgcggttcgctttgccaatatcatttttgagcatatttggaaccgcgattacatcgataacgtccaaattacatttgctgaagcgattggtgttgaggatcgtggaggctactacgatcattctggcgccttaaaagacatggtgcaaaaccatgcccttcaagttctttcccttctagcaatggataagccagccagcttcaaggaggaagatgtccgcgctgaaaagattaaggtcttccaacaccttcgtcagccttctgatgaggacctcaaacgcaacttcatccgtggtcaatatgcagcaggttccattgacggaaaagactacgttagctacttggatgaaccaaatattgccgaaggttctcagacagaaacctttgcaggaggtgtcttcttcgttgatactgaccgtttccgtgatgtacctttcttcttccgtacaggtaaacgtctgacagaaaagggcacgcgcgtgaccatcaccttcaagcatgcggaagatatttttggtcaaccttccgaagccaatgtattgaccatcttcatccaaccaactgaaggcttcatgctctctatcaacggtaaggaagttggttcccattttgctcttactcctgccaaactcaacttccgccacaatgcaactgctcttggaaattcacccgaagcctacgaaaaactctttttcgatgtcctaaatggtgattctactaactttagccattgggaagaagtgaaagcaagctggagcttgattgaccgcattgttgatttgtgggcaagcaaccaagtcccactccacacctatccagctggaactatgggacctgaggcagcctttgatttgctagaaagctacagttgcaagtgggtttggacacctgatgtctggtatcgtgaacgtggtttattgaaatagtcatttagtttagctttgattacttcgttaactcgctttgccgtactccacgaaagtgacttgcttcgcatgtcttatttccaacctagaacagcctctaggctgttctagcaacctgcacctcgttgccttgtactaaaagcaaactaaacgactacatataaaaactggagcaatccagtttttttgggagatatttatgactgaaatgaacatcattctcacccaacttgaagtagccagccatgctggcaccctcaagcgttatgaaaaaattggcgaaactaagccctactacggagttccaatgggagctatttctggtatcgccaaggcctataaaaatcgactggacttatttgccccactctggcaaacaggtgtcctagaagcacaatatttagctattcaagttgccaaggctaaacctaaccaacttccccaagctgacctagagaattgcctcaatgaacaaatttcggtcaatgtcctcgataaattggcttccattatcctcagcaaacgcaaggatagcaaagactgggaagaatacttactcatccaagaccaggctatttttcaacgattaggttggttccttcgtgccaaatactttgctggaagaactgcctcaaatcaagaaatcgaagaatctctagaccatattcgccagcatttgcaaaccgctgacccgcttgtccaatggaccatgaaccaatgcttagtggagattgcagttacctatcctgactacctggaacaaggtcttgcaattggtcaggaattggccgtctatgcgaacatgaaagttccaaaaggctgcacttctgcctatgcaccagactggatagaagcgttgttgaggaggaaataagatgcaacataaaggaactcagattttagaaacagaacgtctaattttacgcccttttcaagcaagcgatgttgaatcagttttccaaaactggacttcagatgaaaaggttaccacctatctgacctggccaacgcatcagacactccaagatactgaagactatgtccagttctgtcttcaatcctattcacaggaaaaaacatacaggtgggtaattgagctcaaagaaaatcagcaacccattggagatatttccgttgtcagccttgatgaaagagttcaagctgccgaattaggttgggtgttgggcagtaaatggtgggggcaaagttatatggccgaagctcttgaagctgttaatcactatttattggaggaagtgggctgtttacggattacagctgttcacgatagtgaaaatcgtccttctggtcgtgtcatggaaaaagtcggtatgacctatgaaggaactctccgccaagccgctcgaaacaatcggggtattgtggatattgccatttactcactgctgcatacagatagaaaaagtcgctagttcattgaactaacgacttttttctataccaatccttccaatagcccacgcatgaattcttcggatttgaattcaccgatgtcatcgattttctcaccgaaaccaattagcttaactggtatatccagttcctgacggatggcaagaacgacaccacccttggctgtaccgtctagcttggtcaagactagcccagtcaatggagtaatttttgcaaattccttggcttgactgagggcgttttgacctgtggaggcatccagtgctaagagggtttcatgcggtgcatcaggtagggtccgtttgatgatgcgaccgattttttccagctctgccatgaggttttctttattttgcaagcgacctgctgtatcaatcatgagaatatccacgccttctgccacggcacgttttaccccatcaaaaaccacactagctgggtctgacttttcaggtcctgtgactactggcacatcgacacggcgaccccactcgaccagctgggctaccgcacccgcacggaaggtgtccgctgcgaccaacatgaccttcttgccagcttgcttgtacttgtaggctaacttaccgatagacgtcgtcttcccaacaccgttgacaccgacaaagagcatgactgtcaaatcatcttggaaattgatttgctcactgaattgaccgtctttttcgtaaatatccaccaatttttcgatgataacacgacggagttcatctatcttcttggcattttgtagcttggcttcatagcggagctcctctgtcagcgtagaagcaacttgcacacctacgtctgacaaaatcagcatttcttccaactcttcgaaaaattcttcatcaaccgaacggaaattggcaaagaattcattgagccttgccccaaatcctgtacgcgtctttttcaaggtacgctggtacttgtcctgttcactttcttgccctactggagcaacttcctcaacaggctcttccttgaccttggtttgaatagcagggtcaaagccttgttcctgcgcttccttcactcgagccgcagcggcttctttggctgcataatattgagccatcatgtctaaggtccgttgtttctgagcttcttgttcggctgtcaattcagtctctgctacttcagactggaacttttccatttcttgagtagctgactcaacttcagtagttactgtatcttcgctagaagccgactgctccctttccacttcttcaacaagagcgacttgctcctcttgttttttttgtccaaataatcgatcaaataatcccatactagtcctcattcaatacatagtgctcgatgacccaagcaatgccatcttcatcattgttttttggcaggacaaggttggccgcagacttgatttcatcagtcgcattagccatggcaacacccagaccagcccattcaatcatcgaaagatcatttccttcatcgccacaggccataacttctgactgatcaatccccagatgtccaatcaacttagccaaaccatttgctttatgaacaccttttggactccattcgagcagaatatcacgcgatttgaaaatctcgaaacgctcgtgaagttccgcaggaatttttggaatttgtccatccaaaaagtctgctgccacagctgaaactgccttattgtagacaaaatcttctggcatttcctcatcgcttgccacaattttattaagcaatggattacaagttagataaagtgattcatgggctgatggtagagaatagacatcgccaccatagagaacatccagaggaaggtccaagtcatttgtcacacgacggatggtgcgcacatcttcaatggtgaagccaaccttatccaaaactcgacctgtattttcctggactagaccaccgttaaatgtaatcgaatattgattctcccctaacagatctagttcttctagaaaagtaccgatagcttgtaaaggacgccctgttgtcagaactacataaactccacgctcacgcgctgcctgcaaggcctttttattagcttctgaaatccgtttgtccgatgtcagaagtgttccatctaaatccaatgcaatcaacttaattgccatttacttcctcctctaaataggctaatactgctccatcattgcaatgaccaatcatccaatctgcctgggccttcacttcctctcttgcattttctgtcgcaagagccagaccagcaaagtcaaacatatccaaatcattttgattatcaccaaatgccactacatcctgacgggtaattccaaaatgagcacagagatgactcaatccaactgatttatttgaaccatttggaattatatcaatattgtcaaaaccagttgtcatggccgttacaccttcaaatgtatcatttaaccatcgtctagcatcgtccatttcctcaggagaaaatttggcattgatttttataatctcttctcgaacttcttcaaatgtgtctaccaatcgaaaatgtgcgtaataattcgtcatcgcttctaaaaactgaggctcagcattttttaataaataaaagttttcgaggccagacagcaccatggaacgactgctaccaaagggacctgcatcaatacctgcgataatcggcagataaatttcaggactaattggatcatccataaagatagtctgcccctgatattcaacgattgaaccattttcagctacaaacccgatttcatctacaaaatcttcaaaaacaagtttcaggctttgcatagatcgcccacttgctgccacaaataaataacctttttctttgaactgattcagtatacgacgaaaccgttccttatcaaaactatggtcttctcgtaaaaaggtaccatccatatcactggcgtaaattttgttaatcataatttctccacatctttcagcttaacggaaacaatcttggacacgccagattcctgcatggtcaccccatacatggcatccgctgccgccatggtccctttacggtgggtcacgacgataaactgactctccttatcaaaacggttgaggtagtcgccaaaacgtttgacattcgcctcatccaaggctgcctccacctcatcgagaattacaaaaggaatggtcttaacacggataatggaaaatagcagagcgagggccgaaagggctttttcgccacctgacataagattgagagattgaattttcttacccggaggttgaacagaaatctccacacccgcagtcaataggtcaccttctgtcaaaatcaaatccgctgaaccaccgccaaacatttgtttgaatgtctgcttaaagctttcacgaatagcttcaaaagtaaccttgaagcgctctttgacttcatcatccatctcgtggatagtatctagtagtaaatcacgcgccgacaaaatatctgtccgttgctcattgaggaaggtcagacggttattgacctcgtcatactgctcaatagcatccaaattgactggacccaaagcacgaatagctctttctaggtctttgaggctttgttcagcaactgcaagattctcaacttccttggcctgagactgagcagcttcaaaactcaatttgaaatgctcggtcaaattaccaagtaaagtccgtaatttatcgcccgcttgctcacaatccgcctctaacttagcctgcttacggatcaaatcatcattcttagtccgagcttgttgcaatctttcttccaagtcttcaaactgcccatcaatatcttccaactcaaactttaagcgaattagaatctgattggtctggttttgcttatcagatgcggcctgcaattgttcttcaagaatctcaatgctagtatcttcaagagcttctaacttctggtcaatcatatcctctaaaagagaaatttccttatctgcaaccactttttcttcttgcaaacgtctcagatctgtctgttcaaaacgaagttggctagtcagttcagcttgttccaaagttagttgacccttctgagtctgtagtttctgcaagctttcttgaatactgtcgcgattatcacggacttgattgatttgttgatccaaggctagttttttctcattcaaggcttggacatttacttcttccttagcagcagcctcttctagctcagtcaaaatggtcggactaacctgactcatttgcaggtcatactgggctgatagctgagccagtctattttctgcctgttcctgatgaatccttgcgctctgctggttcaatctagcttcttccccctccgccttaatcgtttccaaggcttctctggtttggtctaagctagttttcttagctgcaaccaagctttcttgctcctgcaactggctagacagctctgctatttctcctaaaagagcatccagttctggtttgataaaggtcgtgctgttatttcgattgctaccaccagcaaaggctccaccaggacggatttccgctccatccatggtcaccatacgcacttgaaacttggtcgcacgcgccgcctggttggcatggtcaatgctatcaaaaatcgcaatagtgcctagcaaattttggaaaatcgcatctaaatttggctgataagtcaccaaatcacttgcaagccccaagaatccttctgaagattctagtaaagagacttgctgtccagaaagctgacgtggcttgatagttgttagaggtaagaaggttgcccgtccttgccgtttttctttcaaaaatgcgatagctcgtttagcagtcgcttcatcttcaacgatgacgttttgactagcaccgccaagagcaatttccaaagccgtttggtaacgagtatcaaaggtcaattgttcactgactgctccaataattcctcctaagcttggtgccgcctgtaagacagccttaacccccgcgtagaaattggagtgattttttaaaatagcttctaaactagactgacgagcctgcttgcctttcaactgatccagcaaatcaaacaagcgaccttgctcagcctgataagcagtctggacttgatccaattctgtttttttggtctgatagctctcaagcaactggcgtaacacgtgatcagcttcttctaaacttttccgactcttatcaagtacttcttgagctgtttgtttttccgtctgcaagcgtgccaagtcttcagatttactctctgaaagactgatttgattggcaatatcctgctgaatcttggtcagactgtttgaagcttctgcctcttcctgcatcagagcaacatactgttcacgcagatgatctaaaacctgatcaggatcttctgaaaagtaggaaatttctttgtctaccgcagcaatatcgtctttcaagctagacaaggaactatctaattgcgcaagcgtttcttgcttttgctcaatctgttctgccaactgctctcgtctagtcaacaagttttccaagcgcgcctgcgcttcttgatgacttgattcgttttgactagattccagtttatggacctcaatttttcgctccaaatcactgattaacttggtcaaatccaacagaactgcctgttcacgctccaattgttctgaaaggcggtggcgcttctctttcaagttcagattttcttgctccagctcagaacgctgtttgtagtagctagtcaattcagttttgacagactctagttcggcctctttttccgataacttttccttaccaagcgacaactgagccaccaaaacatttaagtataattccttacgttgaccatctaattctagaaatttcttagcagtttgtgcctgtttctctaatggtttgacctgattatctaattcgtagataatatcgtccaagcggtccaagttgtcctgggcctgtgccaacttactttctgtttcttttttacgcgtcttgtattttaagacccctgccgcctcttcaaaaatagcacggcgttcctcaggcttggaattgaaaattgcttcaacccgcccttgtgaaatgatagagaaagaatcacgtcccaagcccgtatccatgaaaagatcatgaatatcccgtagacgaaccttttgcccatcaatcaagtactcactatcaccagatcgataaatgtggcgttctaccttgatttctttctgtttattggcgataaaacctgtgctattatccaaggtcacgacaaccgaggcatagttaagagccttgcgactttctgttcccgaaaagatgacgtctggcatcttgcctccacgtaggcttttagcagacgactctcccaaggcccaacgtagactttctgtaatattggacttgccagaaccattcggtcctacaacagcagtcactccacgatcaaagactaccttagtcttatccgcaaaggacttaaagccctgcatttcaattgattttagatacatacctatcctctagcctccacagcatttttggcggcggcttgttcagctaatttcttagagcgaccacgaccacgaccaatcacacgctgatcagcagatacctccacttcaaaggtcttatcatgggcaggtccagactcagctattacttgatacgaaatagcaatctcaccattgacctgcaaaatttcctgcaaagcagtcttatagtcggtcacgcgctcaaaattccctttttctaaacgaggaatcatgaccttatggataaattcctccacggtcttttcccctttgtccaatagcagagctcctaagaacgcctcgaaagcatctcctaaaatagtatcgcgatttcgccctccagacttctcttcccccttaccaagacgaagaaaccgatcaaaaccacaagcacgtgaaaaaccagccaaagactcctcacgtacaaaggtcgaacgcaacttggacatctcaccttcgggtctatcaggatatttttgataaagatatttggaaatcatcaactggagaacagcgtctcctaaaaattccaagcgctcattatgtgaaatttttagaaggcgatgctcattggcataagaagtatgggtaaaagccgtttctaataaattcaaatccgaaaaatcaatcccaaaatcagccaataattttgcatgtaaatctttcatctatatgctcctttctaacttaaacgaaatagatagtttacatttactccgtcctaacattataccatattttccactggacttctcttgtcaactaagtttcagccagcacctctccacatctttttgcaaacatttacatattcatcagatttcgataaaatagaagaaaaaagaagaacgttagcatgcaaaataagacaaaaccactcaatacatcactgctctccctcatccagttcatcggagccattctcgttatcgccctccattgccgcaggttatttgaaacagaccagctccacttcatccaaaaatcaatctttagtcgcatggtcgttccctacttcatggtcacagccagcttcttcctccgacgcaactaccccagcctctccaaacaatacctaatccgctacagcaagcagtacctgacctggtccgtcctctacctacccttctacctcttctacctaaacctccaagaaatccccctactccactaccccctcgcactcctagtcggactgacctacacaggcaccagctaccaactctggtacatgcccgccttcctgctaggtcttgtccttgtccactattctttaaggaaatggggctggcgcatcacagcttgtctagcctgccttctctatcttctaggctcagtcgaaacctactcctcctacctggcagaatcgattttcctgaccgcatttgacagctacaaaaccttctttttcaccagccgcaacggcctcttctacgcaccgatttttctcctgacaggcttttatctagccgacaaactcaatcaccccattttccaataccgacaaaaaaacaaactacttgtctgcacagcccttttagcttttgaagccactgtcatctatctcaaacagggctacgacaagaactttctatttagcctgattccattcacagcctatctagtcgcctggaccctaaccacagatctattccgccagaaaaaattccaatttctaaaagaatacgccagctattattattttatccatgttatcccagtcgaaatcagctttttcttcctagaaaatcattccctgactataatacagcaaggctggctggttttctttatcaccatcatcacttgccaactgctcagctggttaatcattaatactcaatgaaaatcaaaaacagactagctccaacagtctggcaatagactgttggaggtcggaaattagacgaacttggttcgtgaccgtaagatgcagatagaacactgttccttattatatttcaagggaacaggctgaaaagatccactggaccttttcactcatcaaatcaagtcaacaacgtctgattttgattttcgaagggtataagcacaaaagaaccttgtaagatctaacttacaaggctttttttacaaatcaaaatcctctgtcaatttggcaatgacctcttggagaagttcacgattgacactgtatttgacatcgctattttttgtattgaagagaagtaagtcaccgttaatcagcttttgagtgtggaaagacactgccgcccctgtaatagccagtcgttctgcaatgtccttgctcttggcatgaggcttggtcagctcaaccaagacctgatagcgcgtactatcgctgatgactttaagagccgttgtcaaatcatccagatccagctcgtcatttgacagcataatctgatcaattcgacaggaagctaaaagagcgactttcatatagtcaaattcttcgttgccataataagcaaaccaataattccacggactgagaacgaagaattgagcattttcaacactcaaagcatccaagccagtcatggacaactgtttggagtctcgatagagtttctcaatgtcaaaatccctagcaaaggcttcccgctcaactcttgcttgctcaaaatagggctggtagattggaagcatcttatccaagagatggacagaccgctcaactgtttccaggggattgcggatagccagtgaccagtaccacttatctgccggctttttatccgttttttccaaaagttccatgaggctgagggtcttctcacgatgtccgtcattttcagatgccaacatggttcgcatggcatcttctacttcttcttgagacagctttaaaatcaattgacaagcttcctcaactgtctttggatcctgcccatcattcaagatatagaaataaagactatgcaaaatgttaaaaatatatccccagacaaagacttgattgacttcttgacgaaaatctgccaacttttcttcaatctcatcacgaatgtccaaggtatctttgagaatgcctttttctttctgtgaaaaatccgcctcaatcggttcctcacgctccttgacaattaaaggaataaagaatttttcgacaatctcgcttctataatctcggtaatctaatttcatacgcatactttctaagctttaacaactacttcatttttagacttacgccccacaagaatagtatagcttactagtcctacagaaagcaagaggaagatgagagaaatacttgtcgcagaaagcactgtcaccattagggcaactaaagcttgacctgctaccataccaatctggcagaaagcatcaatccctccaccgactgtcgccaatttatcttcaggcagttcatttaagaccaaggcattcattttcggattgaagacacccaaagtcatagctgtcacaaaaataatcgtcaataccacataaatattgtggagaaagaaacctgagaaaatcaagactggcatcaatgtagagaatttgaggagattgattaagctgacatttttgaacaaagccataccgatacttgaccccaagatactaccaactgagaagaaaatggaaatcaaagcaacggttgttcctgcattgacaatcacaaagtctgagaactccttcatatttagaataactaatggtgaaagtgcggtaaaaatggcattcaggctggcaatggtcacaattgacgctttgagaactggaatattctgaacagcttggtaggattctttgagactgttacgcatgcccttgataatacctgcttctgtttctgtttgctcagcttcttggattggattttccttcagtagcttggcaagagctggacggagggttgccatgatagcaagactgaccaagaaggtccctgcattgaagaaggcgagattctggtaagacataaatccgatcaggatagcaccgctagcttggaaggcaatttgcaaaagacttttcaccgtcatcttaaaagccatagctgtttcacggtcttcagcagccacaacccgcaagctgactggcatatagagaccgttttcgtattgaccagcaaggtcagacaggaagttgatgacgcagaccaccgccacaacccagagggctggtgcaaatcccatcaagaagccaacaaaggcatagagaccgacacgaaccaccagagttgcaagaatggtatccaatttgtttttggtcttgtctgcccaaatcccgataaagaggcctgccaaaatcggcaaggtttcagatgcggtaatcatagccagggcaaacttggtatctggtaagagtaaaacatagttcatcaaagccagatagtaaagcgtatctccaaagttggaaatcaagtctgccacaaagctagatagaaataatttattgtgaatcaaccttttcataaacgtctccttaaacatcaattaaatatttgtttaatgttattttacactttatttcaataaagtcaatatttaattttataaaaattaatttttttaaacggtaaattctcaaagtaagttctagttcccgtccttccagaagttactctgagaaaactgcataacatcaacagaatttagtctcagactaagttctgtttttgactaaaaatgttgataatagtgagttttagggttgaaaatgttgaaaaaagagtacactaaagttactggctctgagacgtctcaaagtaagttctagctatctggaattttggatggaacaagttcctttctattttgaaattattttttgataaaaactagcgattacttatccaataatcgaggtgattgaatgacgttctcagggtcaattttagagattcccaaaagtgttgccaattcctcaccgtaggtaaatgtaaagagttcataggctgattttccgttgaaagaagctcgtttgacgctgttgatatgcgaacaaaccaggttgatgtcctcctgtgtcaagttgtcaaaagaacttcttttaggaagaatatctctgataagtgtgtgattcttctcaattctccccttctggtcagaacgattggggtcacagaagaatagcttagattctccgcgaacatccatttcgatatcgtccactctagcgaattcaccgccattatcggtcagaatgacaggaaatatttcgcaaaagtccatctctttctgatgcaggtcattcttgatagcgtagagatgtttagcgacctcattagctgttttattatcaagtaattgagcgaagataaagttacagaaggagaggttaaaggtgagaagtacctttccgccgatccgtccagtaacggtgtccatttccagccaatagctgattcctttctctgtgagaaagcgttggaagtcctcgtaagaccgtccttctttggcgattttaggaatgggttgtaggtttctgattctccgctttctgaatttcacgacacgggggaaatcaatgggctttgtggacagatagcctttttcaaggtatcggtagatagaagctctggatgccgacatttcgtttgaggcgatgatgtggttgaggtgttgtcccttttggatggcagcagaaacaatctcatccatgcgatagaattcttccttgtttagtgcaacacctgttctcgaatctgagagcttaacttcataatcaagctgagctctttttgcgtagtagaactgtttctggtatccgcagttgcttctctttttcggacaggcattacaaacgtaaggagtctttttgagtagagggcaggcctcacaattggaggtactagagttctcttttatcaccctatttctccgaacttcttttgaaattgtggacggatcttttcctaacttagctgctatagctgagaagggcttaagttgttcaattcctatttgaatatcattgcgatcagagagagttaagtgtttgtttttcattgtcagttaccaacttgtcccatagtaagttctaccttatttctttgtctcagtctaatttccagtttttaagacagactagaacttactttgggaatttactaatttttttaaacacttgtttaatttttcttctgtctgactttttcttgacaagattagcacagtttgttatagtattgttcgggcacctcttttgagaggtcggagaaaaggctccctagttttagggagctattttttgttttcccagagattaatacacatttggaggacatatttatgaaaaaaatcgcatttgattcaactaaatatttgaatttgcaacgtgaccatattttagagcgtattgcccaatttgaaggcaagctctatatggaatttggcggaaaaatgttggaagatttccacgcagcccgtgttttacctggctatgaaccagataacaaaatcaaactcctccaagagttaaaagaccaagtagaaatcgtcatcgccatcaatgcaagcaacatcgaacattctaaggcacgtggtgacttgggtatttcttatgaccaagaagtcttccgcttgattgacaccttcaatgatattgatatttatgttggttctgtggtcattacccaataccgcaaccaaccagccgcagacgccttccgcaaacagttggaaaaacatggtatcaagtcctatctccactatccaatcaagggttatccttctgatatcgaccacatcatttcaccagaaggtatgggcaaaaatgactacattgaaactagtcgcaatctcgtcgttgtcaccgcacctggacctggttcaggtaaattggcgacctgtatctcccaactttaccacgaccaattgcatggagtaacatcaggctatgccaagtttgaaaccttcccagtgtggaacttaccactccaccatcccgttaacttggcctatgaagcagcaactgccgacctggacgacctcaacatgattgaccccttccatctgcaaacttacggcaaaactgcggtcaactacaaccgtgacatcgaggtcttccctgtcctcaaccgtacctttgaacgtattttgaacaaatcaccatacgcctcaccgacagacatgggcgttaacatggtgggctattccatcgtggacgaagaggctgcgatcgaagcatccaagcaagaaatcatccgccgctactaccagaccttggttgatttcaaagcagagcgggtgagcgagcaagcagttaaaaagattgaactcctcatgaatgaagtcggtgtgacgccagcagatcgtaaggttgttatcgctgcgcgcgaaaaagcagagctgacaactagccctgcccttgctattcagttgccaactggagagattgtaacaggtaagacatccgacctcctcaagccaactgcaactgtccttctcaatgccatcaagcaaattgctaacatcgatgatgaaacacttctcatcgaaccaaactacatccgtccaattcaagaattgaaggcagattatctggataagaccaatacacgactcgatgcaagtgagattcttaacgcccttgccatcactgcacaagatagccctcttgctgcacgtgccatgaaagaattaggccaattaaatggtagcgaagcccactcgactgttatcctatctgatgaagacaagagtgtccttcgtaaattaggcatcaatcttacctttgaccctatctaccaacacaataaattttatcagaaaaactaagcacacaaaaagacttgctccgacaagtctttttgtgaacagtaaaaaagcaaggattcaattccctgcttttttcaacgattaatcgaaatcaacatactctttttgaagttcaagaacttcttctgccgttgcacattctgtcaaggcacggtgagcatattcttccatcttagctgtatcaagtttcttcataaggctacgtgtacgaagtacagatgttgcactcatagagaactcatccaagcccatacctacaagaagtggaacagcttgttgatcaccagccatctcaccacacataccagcccatttaccttctgcgtgtgcagccttgataacattgttaatcaagcgaaggattgatgggttatatggttggtagaggtatgaaacttgttcattcatacggtctgcagccattgtgtactggataaggtcgttcgtaccgattgagaagaagtcaacttctttggcaaattggtctgcaagcattgctgctgcagggatttcaatcatgataccaacttggatatcatccgcaactgctacaccttcagccaacaagtttgctttttcttcatcaaggattgcttttgctgcacggaattcagtcaacaaggcaaccattgggaacatgatacgaagtttaccatgtactgatgaacgaagaagggcacgcaactgagtgcggaacatttggttaccagtctcagagatagagatacgaagggcacggaaaccaaggaatgggttcatttcgtgtggaagatcgaagtaaggaagttccttatcaccaccaatatccattgtacgaaccacaacaggcttgccattcataccttcaagaacagccttgtaagcttcatattgctcgtcttcagttgggaagtcttgtgagtccatatacaagaactctgtacggtaaagaccaactgcttctgcaccgttatcatttacaccttcaacgtcttttggtgtaccaatatttgctgccaattcaaagtgtttgccgtcagctgtaactgtttgagcatctttcaaaagagcccattcagctttttgtttagcataagcttcaccagctgctttaaattctgcaatcacttcttcagaagggttaatcactacgtcacctgtgataccgttaacagccaatacatcaccgtctttaacgatttcagtaatgttatttgtccccaaaacagcagcaatttcaagtgtacgagccatgatagctgagtgacttgtacgaccaccaatgttcgttacgaaagcttttaccaactgtttgtttaattgcgctgtatctgaaggtgtcaagtcatgtgcgataacgattgactcttcgtcgatagttgctgggtttggcaagcgaacaccaagcaagtgtgccaatacacgtttggctacgtcacgaatatctgcggcacgctcttgcatgtatgggttatcttccataccttcaaagatagcgataaacatatccgtaacttctttcaaaccagtctcagcgtttgttttcttcgcacgaattgtttccttaatctgaccaatcatttctggatcagcaagaaccatcaagtgtgcatcaaatacggctgcggcctcttcacctaggctagctactgcgttctcacgaataacagaaagctcgttttgagatgcttctagagcagcatccaaacgagcttcctctgcatttgtatcttcaactgtaacagtttcgaaggacaaatctggctgaacgagtagatatgccttagcaacagcaacaccatctgatgctgcgattcctttaagcatttctgtcatattcttatgccaatccttctttttccattgtttcagtgatagctgcgattgcgtcgtcagcatcagcaccttcagcagagattgttacgtcagcgccttgaccaacaccaagactcataacacccatgatagatttaaggttaacagacttttctttgtagttcaaagtgatgtctgaagcaaatttactagctgtttgcacaagcaaagttgctggacgtgcgtggatacctgtttctgccacaatgtggaagtcttttgaagccatatttggattctcctttatttttacaaaattgcgagttatttgtgataacccttacaaaggacattataccactttttgaaatcattttcaagatttttttacctttctttcatgtttccgtcataaaaagagaggttcattttactttttcttcattaaatagaatctattagaacttctgaaaattgactagtagattgatgagcaacgtccaaaattttagcaaaatcaagcgtaacatttttatttataaaagcgtcttccaaggcctgaataattaaaacagccgcttctttccagccaatatattccaacatcatacaagccgaaagcaagagagaacatggattagccaaatcctttcctgcaatatcaggagcagttccatgtgtcgcttcaaagatagcatgacctgtctgataattaatgttagcacccggtgagatgcctattcctccgacctgagccgcaagagcatctgatgcataatctccatttagatttgtaagagcaaccacctggaagttttccggcgccaataaaatctgctgcagaaagttatccgcaataatgtcatttactaccaaagtcccctctgcaagttctgtagcaaattcttctttcgccaattcataaccccacttgcggaagccaccttctgtaaacttttgaatatttcccttatgaactaaggtcaccatcttcaattgatgttctagggcatattctattgcagagcgaatgaggcgtttactcccttcttccgaaatcggtttgataccaatacttgaagattctggaaaacggatatttaccactcccatttcttcttgcagaaaggaaatgactttggcaacttcatctgaaccagcctcccattcaatacctgcataaatatcttctgtattttcacgaaaaatagtaatatccgtcttttcaggctctttcagcggacttggcactcccttaaaatagcgaatcggacgcacacaggcatacaaatctaattcttgacgaagtgcaacattaagagaacgatgacctttcccaatcggcgtccccaagggacctttgattgcaactaaatgctcacgaattatttccagtgtctcattcggcaaagaagttcccattaattcataagccttttctcctgcaaaaacctccctccactgaatagaacgttgacctgcataggcttttttcactgcagcatcaataactttttgactgactgaccaaatatccctgccaataccatctccttcaatatagggaataacgggacaatctgggacaattaaccgtccctctctcattaggattttttctgccatatttacctctttccaatcgggatgtaaaccaaattcctaccacctaagtaggaagagcgcggacgaatcaatttattatttttccgttgttcctggacatgtgcaatccaccccgccatacggctcattgcaaaaatcaatgtaaaaatatcactatcaatacctagcacatggtaaactgtcgccgaataaaaatctacgtttggaattaaaccttttttggttttaataaagctttctacttcctctgacaatctataaaacgcttcatcgtctgttccgaatgtcaaatcacgcgccatctccttcaaatactcttggcgaggatcaaccgttttatagactcgatggccaaatcccataattttttccttcgaatccagcttcttctgcaaatatctctcggtatcaccactctcacgaatagccaacaacatgtcaaacactcgttcatttgcaccaccatgcaatgagcctttcagagtcccaattgccgtggtgacacaagaatataaatccgttaacgttgatgccgtgacacgcgcagcaaaagtagatgcattcaattcatgatcagcatgaagcaccaaagctttgttaaacgctttgatttgtaaatcactcggctcctcaccattcagcatataaagaaaattcgccgcaaaacccagatcagaccgcggttcaattggaaccaatccgcgtctcaaccgagcaaatgttgcaataatcgtcggaaccttggccataatctgaatagattgttcatacaaagcctctaacgaattctcttcagcgtgtacattatatactccaaggagagatactgtcgaacgcaacacgctcattggatgcaaatgtcgccgtgattgaatcagaatacattgctctaccgcatctgaaatcgcatattcttttcgcaggcttttctcaaaataatttaattcaatctgagttggcaaatgcaggttccacagaagatagatgacttcctcaaaagaagcgttattctccatcagttcagcgatgtcataccctgcataggacaagcggtcattttcaattgcactgattcgcgtatcacaggcaatcgcatcttttaacccattcgtttctgtcatacctttcctcctaatttctttcttactaccataggtaaaatacctccgtggcgataataacgaatatccgcttctgcatcaaaccgcaccagagcttgaaactcctttgtaacatcgtctgtttgcgcatggactgttacaatttgaccaacaccgacatcttctggcaaatcaattgtatagctttcatgtccagtcaagccaagactttctgccgactgaccttctaaaaattgtaaaggaagaacacccatcatcactaagtttgaacggtgaatccgctcaaatgactcagcaagaacagccttcacaccaagtaaacttgaacctttcgctgcccagtcacggcttgaccccatcccatagtctttaccagcaataacaatactaccgacaccaacttccttatatctcatagccgcatcatagataggaagaatctcttcgccaactcttgtccaaccaccaatttttccatctgccagctcattctttatacgaatatttgcaaaagtcccacgtatcatgacttcgtgatttccacgacgacttccataagaattaaaatccttataaacaatgccattctcttcgagataacgagcggctggactcaatcgtgcaatattccctgccggggaaatatgatctgtcgttacagaatcgccaaatttagccaaaacagataaattttccagtggttttatggataaatctgcctgcatgttgtcaaaatagggcggattttgaatataggtagaagatgaattccaattgtaattcttatttatttttgtttcaatcgcattccaagcctgactatctgtaaatacctgttggtattcttccttataaaggtcacgagtcacataacgctcaatgtagtcgtctacctcctcacgacttggcataatgtccgcaaggtagacagcttgttgcttctcatcataccccagcggatcccttgttaaatctacattcatatttcccgcaatagcataggcaactacaatcggtggactcgctaagaaattagcttttaccaacggattaatccgtccttcaaagttacgatttccagataataccgcagaaaccaataaatcttcttccttaatcgcctccgccacttcaggacacagatcacctgagttaccgatacaagttgtacaaccataaccaaccaaattgaaccctaaggtatctagataggtctgcaaacctgattttttcaaatagccagtcactacttttgagcctggtgccaatgacgtcttgaccgtcttagaaactgccaaacctttttctaccgcatttttcgccagtaatcctgccgccaaaaggacatacggattggaggtatttgtacacgaggtaatcgccgcaatagcaacatgacctgtttgaatttgctcatctccttcaacatacttaaccgaggctgttttatctaactctgcttcctccaaaccaaatccacgcacgcctacttcacgtattaaactagcctgaaactctgcttttgcatctgttaattctatcaaatcctgtggtcttttaggaccagaaatagatgggactactgtcgataaatccaattctaaaaccttgctataagacggaaaacgttcagcatcatagaataaataattagccttagcataggcttctgtcaactccacgtgctcctccgaacggttggtcaatctcatataatgtaaagtttctccatcgatcgggaaatagccacaagtcgcaccgtattctggagccatattggaaacagttgctcgatccgctaatgtaagagaagataaacctggtccaaaaaattcgacaaacttcccaactacattttcctgacgtagaagttgagtgaccttaagcgccaaatccgttgcagtggcaaccttaggcaattgcccatctaggcgaacaccaatcacctcaggaacgggaaaataagatgcttcacccaacattgcagcttccgcctcaataccacctacaccccaaccaagtacaccaataccattaatcatggtcgtatgactgtctgtaccaaacatagaatctggataaagcaaaccatccttgttgataataacatcgcttagaaattcaatgtttacctgatggataattcctgttgctggaggcacagcgcgataattttcaaaggaattctctgcccatttcagaaattcatagcgttcattatttctttcgaactctaaggcaatatttttctccagagcatcttcagtcccaaaaaaatcaacttgaacagagtggtcgatgactaaatccactggaatttctgggttaatcaattcagggtttccacctgctttcaccaccgcatcacgcatggaggctaaatctaccacaacaggaacacctgtaaaatcttgcaaaataacacgactaggtttaaaaggaatttcccctttaggagaggcagcctgataatgaagcaactccattatgtgattttttgtaacatccacaccatcttcttttcttaaaagactctctaataaaatacgaatagtatagggaagtgaatgaatatccactttttcttccattgaaatcgactccaatgcataatatgaatattcttcccctttataaaacaagcgctttctctgtgttttttccatattttataacctctttcgacattattgaatagtatagtacaaaaggtaatatatattcaatacatgtataaccataaatgttatattttgtaacatcgtttatttccttcaaaatattatgacatttgtaaaaaagctgatttatactttaccgagagattgttagggttatcaaactaaatagaaacagctatgtaaacgctatttttcgacttggcagcattggacggatgtacaatatatggtgtcttatgaaaatattgtgcactatattttgtgattttaaataaacttccttcttgactttaaccttaaaatcttgtatcctagattggtaacaaaattgggattttttattaatccctcatggacaaaggagaaattgaatggtaacgatctattcaaaaaatgattgtgtacagtgtaaaatgaccaagaaattcttggaccaacatagtgtagattataaagaaatcaatctagatgaacagcctgaatttatcgatcacgtacaaggtctcggtttctcagctgcacctgttatcgaaactgaaaatgatgttttctcaggttttcaaccaggaaaactaaaagccttggtttaactccctactgtttatagaaagagattgcgactatgagtttaaaagagctaggcgatgtgtcctacttccgtttaaataacgaaatcaaccgtcctgtcaatggacaaattcctctccacaaggaccaagaagcggttaaggccttctttacagaaaacgtcctcccaaataccaagcaatttgatagtattttagacaagattgcttatctattagaagaaaattacctcgaaaaagagtttttggaccaatacagtccagaatttatcatcaaaatcgatcaattcttgaaagaccaaaatttccgcttcaagtctttcatggctgcttacaagttctacaaccagtatgcccttaaaaccaacgacggggcttactacttggaaagtatggaagatcgcgttctcttcaacgccttgtattttgctgagggcgacgaagaattagcactaaacctggccaacgaaatgattcatcttcgttaccagccagcaacaccgtctttcctcaacgcaggccgtgcccgtcgtggtgagttggtatcgtgtttcctcattcaagtcactgacgatatgaactcgatcggacgttctatcaactctgctctgcaattgtcccgtatcggtggtggtgttggtatttcccttagcaacttgcgtgaggcaggtgctccaatcaagggctatgagggggcagcttctggggttgttcctgttatgaaactcttcgaagacagcttctcctattctaaccagcttgggcaacgccaaggggctggtgtcgtttatcttgatgttttccacccagatattatttccttcctttcgactaagaaagaaaatgccgatgagaaagttcgcgtgaagaccttatcactcggtattactgttcctgataaattctacgaattggcacgtaaaaacgaagatatgtacctcttcagcccatactcagttgagttggaatacggtgtcccttatagctaccttgacatcacagaaaaatacgacgagttggtagcaaacccacgtatccgtaagacaaaaatcaaggcacgtgacttggaaacagaaatttccaaactccaacaagagtctggctatccatacgttatcaacatcgatacagctaaccgtagcaaccctgttgacggcaagattatcatgtcaaacctctgttcggaaatccttcaagttcaaacaccaagcattcttaatgattcgcaagaatacttgagcatgggtactgatgtttcatgtaacctcggttcaaccaatatcgttaacttgatgaagtcgcctgattttggacgttctgtccgtaccatgactcgtgctttgacttatgtcacagatcattcacacatttcagctgtaccatctattgaagcaggaaacagtcaagcgcattcaatcggtcttggagctatgggacttcattcttacttggctcagaacttgattgattacggttcaaaaactgctgtagaatttaccaacatctacttcatgctcctcaactactggactttggtagaatcaaataacattgcccgtgaacgcaaggcaaccttccataattttgacaaatcaaaatacgcagacggcacttatttcgataaatacgtgaccggagactaccaaccacaatctgaccgtgtcaaagaactatttgaaggaattttcattccaagtggacaagattgggcggagcttcgtgaaaaggtaatggcagatggtctctatcatcaaaaccgtctagctgttgcacctaacggttctatctcttatatcaacgacgtttctgcttcaattcacccaatcacacaacggattgaagaacgccaagagaagaaaatcggtaaaatctactatccagcagctggcttgacaacagaaaccattccattctataaatctgcctacgatatggatatgcgcaaggtcattgatgtctatgctgccgcaacagaacacgttgaccaaggtttgtccctcaccctcttcctccgcagcgagctcccaaaagaactctatgaatggaaaaaagagaacaaacaaactacacgtgacctctctatccttcgtaactacgccttcaacaaaggtatcaagtctatctactacatccgtacctttaccgatgacggcgaagaagtcggcgcaaaccaatgtgaaagttgtgtaatctgatttacagactaaaataaagctattcaatatttctggaggttttttatgtttggatttggtaaaacaaaacaagaaaataaaaaattaaaaagagaaaataacgtactaaaaaaagcttattcacaaactaaaaaagaaaataataagctcaaaaaaacgagcgaccgactagctgcggatggattacgccacggtagtcctgaagcaggaaaatacttagtcggaaaacgcaaaaaataattattgataaaacgaaagaaagtaatatggaaacctactacaaagccataaactggaacgccattgaggatgttattgacaagtcaacttgggaaaagttgactgagcaattctggctcgatacacgtattcctttatcaaacgacttggatgactggcgtaaacttactgctgaagaaaaagacctggttggtaaggtctttggcggattgaccctcttggatacccttcaatctgaaacaggtgtccaagccctccgcaatgacattcgcacaccccatgaagaagctgtttacaacaatattcaattcatggagtctgttcacgccaaatcttactcttctatcttctcaaccttgaataccaagtctgagattgaagacatctttgaatggaccaacagcaacgaatatttgcaacgcaaggcaaagattatcaatgaaatctacgaaacaggtacaccacttgaaaagaaagtagccagcgtattccttgaaaccttcctcttctactctggtttcttcacgccactctactaccttgggaataacaaactggccaacgttgcagaaatcatcaaactgattatccgtgacgaatctgtgcacggtacctacattggctacaagttccagcttggtttcaatgaattatcagaggaagaacaggacaaacttcgcgactggatgtacgacctgctctaccaactttacgaaaatgaagagggctatacacgctccctctatgatgcagttggctggactgaggaagtcttgactttccttcgttacaacgccaacaaagccctcatgaacttgggacaagatccactcttcccagattcagcagatgatgtcaacccaatcatcatgaacggtatctcaaccggtacatctaaccacgacttcttctcccaagtcggtaacggctatcttcttggtgaagtggaagctatgacagatgatgattatttatatgggttgtagatcttaggaaaaatatcatttctatttttccgttttatagtcattttgtttatctttgacgtgaggctgggcaaaaagcccagcgccacttcttagagttcgtgtcaacatctcagcgcagtggttgattggcggatttgttcgtgttttacactctaaatccaacctaatcaactgtgcggcactccagtactgtctgcagctcattgcctagtactaaaagactatagaaatctgttgagtttaaaatcgtatataatgttaatatatcatctcgatgagattggcataaaaataggaattctcccaccagttaagggaaaattcctattttttgtatatattaggcgattcaaggagggtttcagtgagctctcaatcagaatattctacttcgttctgctcctcttcctaagaagtaaaatttgacttaacttagaatgtagaatctttccaatgaactgtgcaatctaaaacctgttgtcgtcccacttggtttccgccctcaatctgattgatcagcatccttgttgcctgacacccttcttcaaaggcgggttgaacaatggtagagatagtaggggatgaaaaatttgtccattcagtattgtcaaaccccaaaagaccaacctgaggaaagtcatatttaagttctttcatagcattaaaaactaaaggtaacgcccagcaattcggaacgaatactagggtcttttcctgaggatttaccaccccttgaagaaaacatttaatttcctctatgtccgtattttcatctgcaattgttaaatcttgataactttgtttacaatctaacagagcatccataaaccctgtagctcgttcaatccgtgtacttaagcgactaatgtcagctgtaataagaataaatttttgataaccattttctacacatagttgagttgcatcatagacagcatcataattatttgtcttaatccaactggtacggtgttcgtaaagctgactatcaaagaaaaccatatgctttttcttatcctcaataatgcgcgaatattttctaaaatgcgatgtcggctgaataataaaaccatctacacccaacatcagcatactctcaatatacttatcttcgctttcttgattgtaattgctgtttccgatgataacttgatagccactcttatgcgcttcttcttctatacctttgacaatttgattggaaaatgtatttgtaatatcaccaatcaatactccaatcaacttagtattttttgaatttaggctccgcgcaacaacgctgggtttatagtctgtttcgcgaatgactctctcaattctttcgcgtgtctctttggacatcttttcatatttaccatttaagtaaaaggaaactgttgtttttgaagtctgagccagttctgcaatatctttgatggtaaacttctctgacaccttaccgatacctcctttagttactttattctatcatactatccgtactttatcagttattttgcacagaaatgactgtatttttttctgtcccttctaatttttgagtcggacaacttgtctcttatccctatccactactaagcacttacctctcaacttataaccagccacttgaagcaatttctctcccttacatatatcattatcagaaaccactaacagaatattcagtccctttccttgacagctaaaagccaaaccgctttctatcaaatgatagtctgtttggtaaactggcaattgcttgacacgaattgcttcatctgctaatagagtaaatgtaactaatctatcttgaaaactctcttttttgaccagtttattggtctctactagttggttgtatcgaggagaacgcacggttttctggatttcaaaatccttttgactatatagccgaagatcatttaaccgctcttctccaatcttgactctttcatctaaaatcaattgactgatcaactcatgctggcctgagcaatcaacgctatccactatcagcaataaatcgcctccaaccataaggagctgtcgtttatgccagtaaggcaagccttggctggtctgagcctgataaatgccctgcatccaatgacagtgttcaaaacccttataactgtgactaataaactgaggatacgtgtcatattcccatgaaccctttatctgccctggagcattgtcatcaaggatacaagtgctgtgagcccaagcgcttttaagcaagtagcgctcctcgcattcacggtagctgaaacgaccgctgtcaattacgattggttgtcctttgtggtaaaagcacaagctattttggtcagagtggctgtgggcacttcccatgggaccggccttgaaacataaatagctgtccacttctttgacaatactgtgaccggattcagaaaaatgctgtccccctgacgagctggattgagcggtcaagtgttcaaatatgcgcaagccattttctccgaccaagaagagaacgcctaaatctagcttggaattatctactaggtaggtgccatcttcaaagaaaatcgcagtcatctgtaagatgtcagaagtacaatgaacatcgctatcgccaagagccacacttttgccatctggccccgtcatctgtaagacatagtctgccatttttttcaaaatagatgtccactgttttcgataatctggcaagctgaaagctagtcctagcaagagtttataaacttccacatggtagagaaaagactgctcaaactgagttccatcttccaatatctgagtttgaatttgctcttcgatttcctgacgagcaaaatggtgaagctctactaaatccacctgatcgccgatataagcatgggccaagagcattgcgccagtctggaaaattccccaattactcaacgtatctttggcacggtaatgactgtgaaggtaagataattgtttttgaatggatactaacagttggctacgctcagcttcacttagtccgccccaatcaattaaaaatgggagaatattgagccagcttagacagcggatagccgtatctaaggtgcgactgctcgttcttttaggataccaatctgtcacttgttctatccaactaaagataaaccgtttaacctgctccatgtagcgcgaatctttttcaaccagataggccaaaactaatttccacaagtattcctgccgattgagcataaaggtccattcctcatccccatggcagtcggctgtccagtcaagaggagcaagatgatacccgactgaacaaggttccatatcccaattgtcttcaaagataaaaatatcatttaataaattttgacaagaaaggagaagctctttataagctgcatcttgttgattgagaatataggttttgaccgactctgctgactgattggctactattttgccgaatattgtttgcataacaagtcctttctctatcgcttctccaaaagaagagaggctgggcaaagcccagatccactcctcaaagttcatatcaatatctcagcgcagtgattgattggctttaacagttcagtggactgctaaaggttggagataggagttccaaaacaaatttcagcaattcgtatttcatactccgaatctgatctaatcaactatgcgggggtgggagtgaaacagtctggggatagactgtttcagctcaacaactagaaataaagacttgttgacgaactcttttttgactagtcgagttctttcccgctcccccttcacccacgaatttcatttaggagtgcgatctgcgacacttgaaatccaccactgcccccaaggttagcaaacctaagaaaccaagacctaaacttgcttcttctcctgtctggggcagacggggcttactcgactttgttttttcggcagcatgatgaaccacttgtttcacctctggacttggttggttttccttgagttgtttttcttctttttctgttttttcgacacttccagtttgtttatcagaaccttctggcatagtaaccttccagacagtggatggataagccgcagttggctccatctcaacagtcagactagaacctgcctttgtcaactcaatgccattctttacggttcgggtagacggattgtaaaaggcgatgcgatagccaccttcgactttctgaatggtatacaaaccggaatctgttaaggtaatatcatctgtcagcttgtaggctgtatccgtgtatttcacaacgccccagacattctgttcttggtcgtataccacttgcaaatccctgtcttgatgaagcaatttcacactagcagccacctgattcactttttccatagattggtttggaacaaggacgtaagcatagttacttgaagtctgtgcatgttcatgccataggctaacaaaggaattgctcacttcttctttcgactggttgtagttgatgtcactccatttgccagttcactggtctaatttggcataggtcggcagttggttcaagaagacgtaaccgatggactggttgtccttgccattggtcatgtaaaaggattgagtcttatctgtcactacttctttggacaaatcaactggctggccatttatgtaatagctatatttttctccggtcaagagtttacgattttcaatcgttgtcacggcgccttgagcagattgatgctgtatatcagtacctaggaaaacaatcttatttcccagaacaatccaagccttacgagcagtcagactattgttccagttgttgaaattcattgcaatcgtcgctaagcggttgcctaactggcttgctccaacaaagtcacttgcaagagttacctcgccactgccatcttctcgtttgtccttggtcgttgtcgttcccggtaagcgatacgggtcaactgttgcccagtagtggttactgtaatgactcaaatcatcattgtagaggtaaaccatgccatctgctgtataccaacccttgcggttttcattgttcatatcttcatagttttgagttttagaagagtacatagacaaggcaaaggtaaagccttcttgagcgcttcgataaacaaacttatccatattgttgaaggctgcaatataatctttatctacttcagcagggatttgattatcagctaaaagcttgttgaccaaatcaatatccttataggatttgaggctgcggtagctgtcatagaaggtatcagaggtcagctgtgccttaacaaaggagagaagtttgttttttttgctcaggctgagccgattctgcaatgcggaccaaagaccttaaaatctccatagcctgaacatgtgattcaccagttgcccgactgatggaacgaccgcgggtcatatccatcagttcaccgcgaaccaatattggcataaaggctttttcaatccattcataaagaatgttggtctgttcttccttgagggcaaactccgttggctgaataaccggtagtaactgtgaaaaaccttcaataaggacatttccatacgcccctgtgtaggcaacattggtgtggtcgataaaggagccatccttgtagaagccctctcccttatctacaaatttcattatcgttgtcaaaccttgtgcaccagccctcacacggtcagcatcttcgcgaagagcaccttccaagatggccaccttgctcaaatccgtctgattaccgccaactgctgggactggattggtcaatgttttacggatatagtggttggatctggtacaaattttgaaatcggtttggtataggttagaatctcctcctgactaaagtagggatgcatgtagatcaaggtgttgacaaccgcacgcggagttccaatttcataatcccaccaattcccatcaattgacttattttcattataaacattggtgtaaagccagttcattccttttctgaccaaatcgataagtgagcggtcgtggtaataggctgagtctggattctcaactacttgagccatctgctccaagcggcgatagaccgttgtcagatggctggatttactaaagtcaatatcgttgaaaatcgttttgccctgatttgttggttcaacccattttttaagagaagaagctacgccggcatctaaacgccctagaaaggctttcatctgagtatcgttagattggtagcgtttattggctaaagaaatatcttcccagttgttccttaaggtatcaaagactgttgcttgatgctccgtaactgtcagctcgaaactagatagtttggtgtctttatcataaacatctacctgagtctttccagccgcaagcggacgaatcatatttttctctactatggccacagccgcatccgcaatccgataggtcaggtctggccgaacaggcaggtagaccttgttgctggcaagacttatttgccctgtttcaggttggacaagttctaggcttggctctggtgtttctggtgtcttttctacgtattcgaccagcgagatgttatccagccaggcttggccgacactattctcaaaaaacagttccaccttcaatttacgagtttccggagataccgtcaagatctgctctatgtgctccgcttgacttccatttttataaggtgtataggcaaattcttgtggactcaagtccttaccttctgcagtcaaactacgcaagcgaacacgaacaccgctccctttcaggtccttggtttctacattatagctaaagagatagcgcttgttaggatctacatccactgtttggtgcactgccactcgatagctagctgttgaagagatatgcagccgtccctcatcaatgcgaacctgtccgttttctttcttcacatttgcaggaatccatgtttcccagtttgtagctgccggatctgcccaatttcctgatgctgctgttgtactggcgaactccccgttggctactaggttcttctcttcttcttttgtcgcctgaacagcttgcggactagcaagagtttctgcagcggtgcttgaaggctgggtttctgttgatgtaacaggactaacctcagagctgacctcgcttgtcattactgcttctgtcgtaagattaactgcttctgtcgtttctggagttgtttccactaactgactgctttgtggactagctgtttctgtacttggcagttgattggctgcaacccttgttcccaagatagacagcgcgataagggcggagcagacacccaccttatatttccggatgccgtaatgctgcttgctttgactgataaaaaatcccattggtgtttcctttcctttttatgcggggcaaaacaatgtcccaggggtataattttaatcctgcaaccgcttccttgcggaggcaagaaagaagaactacttcgtaaaaagtagttctttggcttttcccataatcgactctttttcaacgtaaacaagaacaccttctgcaatctgcaattctaccaagctgtctgttagtttgatgattttcccatgcagcccagagaagaggataacctcatctccagcctgtaaggttgataagtagcgttggcgtttttccagttgctcctcaagtgctttttgttgtcgcttacgattgacataagaagtgagtacaggaagtatggtcgatagagctactaaaataattagtacatagtagagagtttgttgttccataggcgcttatgcaaggatgcccagccagctacccaaaataccgatgataactgtcaggataactagtttgtaggttgtccatttcttgttcttgatgagatagtaaaccaaaatcgtaaacaaggctggaagcaatgcaggggcaatcttatcgagcattccctggatggtcacaattttctgatctgctccttctgtcaattcacccgccgcaaaggtaattggcaccgaaatttttacaaaggttactgctaaaccagagataactgtcacaccgatgatattggctaccttagaaattgttgccatttggtcactcaacttatcaatcacgctggtaccaaatttatagccatacaaaccagtcaacaacttgatagaggtcaagataatgttcattccaaggaagaaaagaatcggtcccataaccagtccttgacctgctagagaggcagcaatcgtagataaaagtggggctaatacaaattgtgaaagtgagtcaccaattcctgccaacggccccatcagagccatcttaatcccacgagtctcttcttctgggagatcattttctaacatgaccaaatgaagactagtaatgaatggaagaaaatgtggattggtattgtaaaactcacagttttcttctaaagctttagttaatccttctttgtcgtcaccaaaatgcttcttaaaagctggatacatgacatttgcatagccaatcccttgataattactgtaattgaaaccattctgcaagaagaaggcccgtaaagaagtgttgagataatcttttttagttagtttagatccagtcatcgtgtgcttcctcctgtttcactgccacttgttctggtttattaaagaattctttaagtgcaaagatactaccgacaattgcgataccaattacaggcagttgtagataagctgcacaaacatagccaagcaatacaaacgggatcaattctttcttagccattacagacaaaatcattgcaaaaccgatagctggaagcatcttacctgctacactcaatccggttaataatactggtggaatcatttcaaccaatttcaaaagagtatccattgaataggcacccaagaaaccaagagcaaatcctaaaaaggcgaaagtaatcactgtaccatttgcaacacgtttaaatttagaaaggtttcctgcacgaagatgtttgatagctgattctggagcacccgcatgtaaagtatatgctgaagtttgtaagaattgaatacctaccgcaataggtgttgaaagtgctaaagctgcttctggtgttacttttccagcacttgtaatagccatcaaagtaccaaaaataccaggtccgattggatttggaggaacggtccccccagcaccaacaccaaatcccatgtatgccagctcactgatagcacccatagctaaagccgttggtagatctcctaaaatgattccgaccccaaaagaaagcacgatacatcggtttgtgtaaagccccaataatagaccgctaaaacagaaagctgtccacagaccaataagagctgcttgaattagactgatcgtcatgataattctccttattttttaaatataatccaatatattaacttcaactgccccatcattaccagaaggcgttgtctttgtgttgaagcgaatcttataaacatcgttcaactctctcactatagccttatcttctgaaccaaaaaagatagaccgtgttacttgcatttttccaggcgcattatgaatatttccaatatttaattctgtgattggtactccccctttaaccaaagctagtgcatcttgcaaatctttaataactaagaaaatagtttgagcaggattagccttatgaatcacatcaatcactttctgcaaagagaagaaacgcatagctactgaatctggaataaccgttttcattaatgtctgctgaatcttatcttcactaaccttatcatttgccacgatgacagtattacaacctaaggatttaacccatagttgtccctgtccatgaattagtcgctcatcaatacgagccattacaatatttggtgttgccattttaacctcctaccaatataattcccaatctttataaaaacgaagcaaagcttctaagtaataataatcgccccaagtatttccttcattgacaccttttcctgaatgccaagagtagaccccatgtaaaagcaatggacgacctggagctaactcacgattagcatagttatcaatcaaggaccgtagcatcgtgtgcatagcatatttataagtttccttgtcctcatcaacttctggcaaatatttaagcatctcgtgaataccacaaaccgctattgctgtcgcagaagaatcacgagcgtgcccactaccatcattaaaaattaaatcccaataggaaacgttatcctctggcaaacgattaagaaagtagttggttactcctttaaacaaatttaaacatgcgggatctttaattttacggtaagctaacggaataccgtaaataccccaagattgaccacgcgcccaggaagagtcatcactaaatccttgtcgggtaacccctttgagcggttttcctgtttcagggtcaaagtaataggtatgaaatgttgaagcatcatctcgaataactgtattaacagaagcgtagaaatgactaagagctacatcataatatttctgctcacctgtctcctcataagcaaagaaaagtaattgtaaattcagcaaacaatcaataatcaaccgataatcttctgctttaccaagttgcccccaggcctgaataaaacctcccttttcttgatagcgctccattaatttatcagcagccaagagcgaagcctctaaagcctctttactacctgtcaatttataatcagctaccgttgatggtgaatacagaaatcccaaatcatgatgatctaattcaattctttgtttgacacgttccaagaaagatgtcgtattcttttttgctaacgctttcatttcattgttcaaagaatactcatgtcctaaccaaagcgcgcccgtccaaaaaccatttgtccactctgtattatccatctttggataatggttatcaaatgtggccggagtcgggaacgattcaccaaaatattcacaattgataacaagttgttgaatcgccaattctattgcagccacaacttctttcttactcaatagagtggaatttctaaactctctttttttagcaattgactcaatcaaaacatccttaatcatgcatttctccctcatataccatcttcaaataactcttcatcatggttatcctctgctaacagactgaccgaatcaacgattccatctttagaggtggtaatcaatttaccaaccaattgttctaaatcatctgttaaccgtgaaaaattcgcttccaaaatcatcgcaagatttaaacctgaaagaacgacaacattctgctctttctgttctgttgctaattctacactaactttaaaaggcgtacctcctagtaaatcagttaaaatcaaaacttctctttcgcctaatatagctgatttgatgcgtgcttttagttcttgcgccgacattccttcactaaaatcaattgcctcaatattctccacctctcctgcaattaactttagtgaagtaagaatcccactagcaaactgtccatgagcaacgacaatcactttaatcataattctctccttttaactttaccggtttacctacactttgtattgtagactattgacaaccacttgtcaatagattttataaaaaaatgtaagcgttttatatttcgttggacttttatttaaaaaatattctccagctccctcttttcataaacaggagtaccaaatatctccatgtttccgttcaaaatttcccctgtaacatctcactttctcccacattcaaccccgttggaggcaggagaaagtgaaaacgttaaaaatacagtccttattttgaaataaactacttcatcttatctctaacacttgtataagaggacgctaattcttgaattgtaccgaactctcctttagtagctaattgattaaattccccaccgataccaagaacagttgcaccagcgttaaaccattctgaaacattattaagctttactccaccggttaccatgattgaaacatgcggtaatggtcctttgattgcagtaatgtagtttgcccccaaaacactaccaggaaacagtttaaccatttcacagcctgcttccaaagcatttgtaatctccgttaaagtcatacagcccggaagatatggcactgcataaagatgacagatttttgcaacttctatattaaaagatggtgaaacaatataacttgctcctgccataatggcttgccgtgccgttactgaatctagaaccgttccagccccaattaaaacagaaacatcatctttatggcatcgactaagttctgtaataatcatattcgcgtcaggatttgtataagcaacctctatagctgtaattcctcctgcaatacaggcctgtgccgtcttaaatccgacttctttgtcatctcctctaacgactacaacaagcccttgctccttcaattttgaaataatttgtgatggactcattttttctcctttatcgtataatgtcatttttcccctctaataaagactcaacttttctaagagattgccgcatgtgatccccttctatgctacatttataagttccactagcaactgcaaaatctaaaatagcctttaacgacgtcccctctaacaatttatataatgccccagcaacaaacgcatcaccactgccaacacgttgtaacacctgagttttcaattcttgagagcaacaaaattcatcagccaatccgtaagccttatacaaatttctgcctagttcatctgtctgcctaatcgtatggaaaattgcttggaacttataggcttcctttaaagtttgcatccgttctcttattgtatggacagtagccgtatctctttcaaataattcccaatctttttcattagccataataggttccagaccaaaacaatagtctgcataggtcgcaaattgcgagaacactttttttgcatctcttaatccaatcatcttagaacgccaattaagatccatcgaaatcggaattttacgacgctttgcttcttttaatacttgaacaagccatgccctaacagctgaaccaatagccacggtgataccactaaagtgaaccaacccaacctctaaaaataattgttccatatcaaaatgatcgacttgaatagcttccaaactagactggccacgatcatagtagacttgactagaacggcaaccaaatcctgcttccatgtagtatacccccacacgttcccccttacgttgaacactggaagtatcaatccctttcccatctaagaaatctaaaaatctattacctagagagccttgtggtagtgcggtcaaaagcttggtttcacatccaaatccttgaagattacaagcgacattgatttctgaacctccaaaaaacacacgactttctacaccatctgtcaattcttgataatttgttggtgtaatgcgaattaaaggttcaccaatcagtaataccttcttcataaccgccccccactctttaactttctaatactgtttttaaatatgttgcaattgactcgtcctgacagttggcaaagaaatattcttggaaatgttcacctgaaatagtttctttcaaaaaatcttgatcaatttcctgaagtactgtcagtaagtctttataggtgactgctttcatttcattcaaaatacgagcatttcgttgttctggaataacgcgttcacggggatatccgccccccatttcctctgcaaacagtcgctcaaaaagtaatttgagatttaattcagctccccaaccgaatccctttgcaaatggcagagacaaagcatttcctccatttatctgtgaaaagaggtatgcatccgtcggatctaccgcgaagccacaaactacccctggaaaactattagccgccaacatggcacctacccccgtgccacaacctgtaataacaaaatccgctgccttactaactagaaggattgaagccaacagaccattttgtacataagtcaactgactttctccctctttaccatacattccatagttaaaaacatgataccctttagcatctgttactgacttcaatgtttcaaaaataagactatttttagcagcctgactattttcattaataagtgcaattttcatcgttttttcccttcttatatcaaaatttgttaaatttgttaattcgtttattacgcttccggctgtttaccaatgtaagcgagaattcctccatcaacataaagaatgtgcccattcacaaaattactagcatcacttgctaaaaagactgctggacccatcaaatcctcagcttcaccccaacgagctgcaggggtcttcgcgataataaattgatcaaatggatgacgagaaccatccttctggagttcacgtaacggagctgtttgtggagttgcaatatacccaggaccaatgccgttacattgtatatttgcttcaccgtattccgaagcaatattcttcgtcaacatcttaagcccacccttagccgctgcataagcagacactgtttctcgtcctaactcactcatcatggaacaaatattgataatcttcccatgcccctttttaatcatagatggaataaccgctttagaaacaataaacggagcatttaggtcaatatcaataacttggcgaaattgagccgctgtcatttcaatcattggaaccctacgaataataccagcattattcactagaatatcaataattccaacttctgattcaatttgagcaaccatagcctgtattccatcttcatcagtcacatcgcaaacatagccatgcgcattaataccagctgccttataggctgccattcctctatcaaccaactcttgattaatatcattaaaaacaattgtcgcccctgcttttgcataggccgatgcaatcgcaaagccaatcccatacgacgcccctgttaccaaagcaatttttccctttagagaaaattgatccaatgaaaattgctgattcatattcgtaactcccttgtattttaatttgtaaagcgtttacaaattgtattgtaatatagtaaaccggttttgtcaacggtttttatcatttattttaaatactttcaaaacgaatcttgatataatcttataaaattcgagtatcttcattccccaagcaataaaatatacttaacacaagtatgattttcttcttcgattttatcaatcattagtaaacattttacatatcattattcatatattatccaaaattggctatactacattcacgaaagtaaaccatacaaaatgggagcgggaagtgatacgactgactccctcactaccaatttcccacctcaaacaatctccagaatattcgaaaactcaactactccgccgagatgttaataggaactcaaacattaacatttttaccctgtgtttactactctaaataaaaaataccctattgcaacgtgcaacaaggtaccatctatctcaatcatatattctgtaattcattttatatagtcatatcagtttatctttgattacttcgacgagcgaggaaacgtcgtttccttatttccaacctagaacagcttttaggctgttctagcaacctgtagctattgaggagaacttgcttcgccctatctccagccttcaaaggttccccgaacctttgaagcgagtactaaaagcaaactaaaagactgatatgtaaagccctttgtcaagtaaaaacaatcgaactgataaaaaatgaaaagtatctagaaagagcctagtttttagcttcgggcattggccactctaatattcgtggattggttacccacaggtcaatggttctgccgcgagtcctactctctataagcgtggatcacaattgtgtcacttagttgtttcgtagatgactcaaaccttgaagtcctaaactccttcaagatactctccattcaaacattatttcaatccttatttctgtccaaattcacccagtgatttgggatagaaatagggattcctcatcgctctgcgatgataaaacttaattgtcaaaagtgtacatgaaaacaagtgctaacttcaagctattcttcctgtcatcatcccccaaataaaaccagataattcccgtgcaatagctgttttagcaacattttgtttcttattttttcctagaacaagtgtgcgataacgtcttcttaagcgttcattagccttatccgcataagcaatcacctccactcggtttccactttgtctccttttcaattctttggatttatacccaatcgtccccttagccaatgattgtgcagcttctatcagaagtcgtctcacatggctattcccagttttggtgatagcacctcttctctccctgtcgccgctagaattttcgctaggagttagcccaagataagaagcaaaatcaaaatgttgagctgtcgcaaagcggttaaaaccaccgatttccgtcacaatggaaagagcggttagtgttttaatgccaataaagcaaaaaagctgagagaccttctcttgataactgtcgctttgacccagttgctcaattcgcgcatcataccgttctatttgatctactaatttctcataggtcaatagatattctgtcaaaatctctgcgtaaagtccatcaatatttaggggacagagccagcggacatgtttctgtgtccaattactgcttccctcggtatagcgaaaatcatgtcggagacagaaggcaagaatttgttgtttgattttcttcagagccactttgtggtctgttctcatgcagatatattctttgacttgttcatcctcaacagtagaaatatgaacaggccgatagctatgaaaggccagagcttttgtgagctgagctgcatcttttttatcagtcttaacacgcttagatccttccttcatcaccgttgtaggcgccatcacgatacagggaatcccgtgagcttgtagctggtgatatagggtaaatccaagacatccggcttcgtagccacataacacttctacatcttgaccatataaacgacgaagctcattcacatagttcacaatatagctaacatttggaccaactttagtgctatgtttgaattgattcgccatcatatcataatagcagagtgaaaaactttctttgtgaacatccattccgatgaaaagtgtggtaaaatgaaacatataagacctccaattgagtgtggtaattcctgttagaagttgattgttttttattctagtgtacaggtaaatccacgaattctcaactgggggtctttacatattgtctataccaaaaatagaatcatcaaataggaaattccattatttaacatatgtagcgcaatcggataacgaatatctcgtctaattaaatagagccaaccaagattgagtcccatcgtgaaataaatcaaaaattggggaagagttgctggcatatggaccagactaaataaagcccccgttacaaatagatagattccaacagccttcatatctgccattttagggaagaaataggtcgcaaaaaatccacggaaaatcaattcttctaaaattggagcaaagatcactactgagctaaatgcaatcaagggataagctgatacgaattcgatcacaagcttttgattttcactttctgggactggtactataaattggatgataaaaaatgcaatatagagcaatatcggccattgaatcttatggaaccatgaagctgtcacacgataggcaacagaatgacgtggatagatatacttccataacagaataatgagcgcaatggagagaacaagaccaattatcgcacaaatccaaattgtactgtcaatcaactgggcaggtatgtctggtatgctttgtaaagttggtcctaccatcagaaaacctgaagcaatttgataggcaacaaagtatagaaatagtaatgcgacgtgtttgataaattttaacataatccctccctaaaagctcaagtcaataatattatcgacccgtaccaacttggtttcaatctccccattcgctaattcacgagaaattttaacccattcctcatcaactgccaaaatagtgtattcataagcaatagaaaattcctcatcaaagcggattttggctttacttccgatcaattctttcaataaaacggacatctgattttctccttttgtagttttctgcaacttttttaccctagcttgcaactgcttcacttttttcctatctgatagagaattgaaaaatagaaatcctactagaatccataaaaatagtttcatcgtatcctcctatatcaagcccagactctgcatcagtagcatcaacaaaaatccaagaagattattcagactgtgtagaataagtgcattggtatatttgccagaaatacgataggcgagtcccaggaccaggcccatacctccgtagacaacccaagatccgatattggtcggattgtgaataagtccaaacaaaaaacttgatagcaataatcccacaatcgaatccttaccaaatactctccccataagaatccctctgaaaagcagttcctccaaaactggagcaaagaaaactgcaaagagaaacaaaactaaggttggtaagcctgaattgttgatgatttcctgattggcagtcgtttgaccatatccctcttccaacataatcaattgcccaccaattattttcagaccaaacataacgataaaagcgaggactacaaacccaacattcgcaaccatcccccatttctgctcacctttccatagacctaatttaccagtcaagataagaccaagcaccacggctaacaataaaagaactgcagcaatcagtagattattaccgtcaaaatttggtagggcaaacatggccaactgggtcaatacattcagtgcaacgactgccagtcccactaagagaaacttccaatttttaaccacattccaatctttgacatttccaagtctattcatagcaatctccttcacatacactaaatcaattcttatcactttcttttttgaacaatagcagagctggcaagcccaaaaccatcggcaagaggatattcagattagacaaatcaatctgcccagtagccagccattctccgaaaatatagccaactgcgtacagaccgagaccgattaaccccacgaagtaaacaatttttagaaccgatataaactttttattctctttcataatcactaccaaaacctttccttatttaaaataccgacggatcatgcgaacctgcatcacattgatataaatgtgcaaaaacgccacaactagaaatgccgtaatttgtcgttcctgcaatagcatgctaagtacaaataggaatagatacaaacctggtaacacgatttgattcaaagtgaagacgatttggaaactcatttcgtagtttgcttgtttctcaccttcgtccatcgcctcagcaaaatccttcatttcttttaccgtagcaaaagcggataacttatagtcacgaattttctgagttaatttcatgataaaaatctgagaaatgagaagaatgacatagaaaactacatcaaaaattgacccgtacatgatcgccccgtcttcgaagaaggtaacaccaaatcctagaaccaaatttaacaatgtcaatgatacagcaacattgaatgaaatggtcgcgtactctaggttacgatacattttcttatatagttcatcaacatgttcctcatcctcatctgaaatggaatgataaagtttataattttgattagctttaacaccaaaatatacggttccagcgaaaattaaaaatgtaataatcctcaaacaaattagaaaattatctaaattgagataagaaggtaggctgaatttaaagattaatattccaaagaaaccgataaagccacccaaaattgctgaaatcagcatatacgctgaatatctcatccatctttgtttcgtcgaaatttgtttcccctgtttcattcttctacctccactaattgaaagacattctccacattttcattaaaaatttgtgcaatccgcatagcaatgaccaccgagggtgtgtattctcctcgttcaatcaagctaatagtctgccgtgatacttctgccaactttgctagctctgtctgattgagaccatctctggctcgcaattccttgagccgattttttaagacatattccataaattttcctttctaggcttggtagataatcaagcctgtttctgtgtcttcgacagctatatttcccttggcaaacttgaccaataagagataggtatagtagaaatcacctgcacaagaggcagcgtgcatggttgccagcatgaagtaaagagtaatattcatcatcccaaaacctgctaccatagtcaagaccaaactaatcacaacaaagggtgctagggaaatcaccagcatttgcatccgattgtagagggaacctggactggtagcataggccatgcccgatttccatttaaacccgtatttgacaggattttcaggacaaaaaaccttgaagaagatgccgtggatagcctcatgcacaactattaacagaatatagagtgggataagcaaccatacctccgacacggatagctccgagtattgcgaaccgttagctatcaaccaactgactatcattccaaatacgaaggcaaatggaaagatgagtaccacagcaagaatattcaatccccacacaaatttcttattttccatgatattaacttcatataatttctttttagcttccatttctcttctctttagatttcattttgtaaaatagcagagctgtcaccaatgtcgccagcaatggaggaaatagataacttctctcagtcaaactcatctcaaaacctaacaaagataaaactttaaacaccaaaatatttatcaagaagagtacgaaaaatagtaggactactttcactccgtttttaactgtcttgttcattcttcttttccttttctctgccgagagtggttttcaaaatgaatagggaactcaccatcatcaagagtggcaccatatctataggctgaccaaatccaagaatttgaacgaaagcatatatcaaaaatagagcaattataacttccaaacctcgcacaacacttgttcctgtaatcaaaattccttttttattgctactggttttcataattttccaccacctactactcgactaattttactactttacctttgactcttttctgccacctagtttcttcaagcttccagttgtcactgcgatggcacaaattgcaagagtcacatgagtctgatccaactgctgccacttcataatgtcagctagtaggacaaaaactagatagatgatcgcgataagttgtacaaaacctgccatgtcactattgtttatctttttcatatatagttcctactttctgtttatttaccagatggattcgttttcatctttatctcaatatcattgtaacacttacttttctttttgacaactatcattgtcaaaaaaataataatttttgtcaaaaagtttatgaagttcgtcaaaatgactagaataacatgcaaaaaactcttctacccaatggataaaagagtttattgagcgattatagattatcagctacgctgttcaagagggtttggattgcagaggcatcgctaccacctgccatggccatatctggcttaccaccaccacgacctgctacgattggcgcaaggactttgatgaggttacctgcatgaacatcgcttgacttgcttgccacaaggacattgaccttgtcgccgatggccgcaaccagcaccaagacatctgagtagtctttctgcttccagttgtcagcgaaggtacggagggcacctgcatctgaaacttggacttggctggcaatgtagcgaatgccgttagcatctttgacatttttgaagacatcaccagcagcggctgccgctgctttttctttcagagctgcattttctttttgtaggtcacgaacttgttgtgcaagactttcaaccttgtttggcacttccttgatttgtggtgacttgatggttgccgctacttctttgagggcatcttcttggtcacgataggcaaggaaggcttcacgacctgttaccgcaatgatacggcgagtacctgaaccgataccttcttctttcaaaatcttgaagataccgatttcagcggtgttgccaacgtgggtaccaccacagagttcgacagaatagtcaccaattgtcaccacacggacttctttaccgtatttttcaccgaagagggccatagcacccatttccttagctgtgtcaatatcggtttcaaccgttacaactggaatggcattccaaatttgctcattgacttcttcttcaatacgacgaagttcttccgcagtaactgcctcaaagtgcgtaaagtcaaagcggaggaagtcttgctcgttcaaggaaccagcctgtgttgcatgctcgccgataatattgtgaagagctgcatggagcaagtgagttgctgtgtggttcttctcaacacccttacggcgttttgtttcgatttcaagtgtgtaggtttgaccaactgaaatgcttgcggacagctcaactgtgtgtaatggctgaccatttggtgctttctgcacatcgatgacagtcgcaacaatgtctccagtagcatttttcacaaaaccatggtctgcaacctgaccacccatttctgcatagaatggtgtttggtcaaagacaaggagggcttgaccttctgagactgcttctgtacgcgcattatcagccacaatgacagataagcttgcttcaagagctgtttggccataaacaaaggtcgactcttctgtgatagcagccagggtttcattttgcatccccattgaaccacctttgacaactgaagcacgggcacggtcttgttgctctttcatagccgcttcaaaaccagcaatgtcaagggtcataccacggtgctcagccaattcttctgtcaattctacttggaaaccataggtatcatagagtttgaaaatgtcacgaccatcaatctcagacttaccttctgctgccaatttatccatcaattgctcagcaaattgtgaacctgtatggatagtacgagcaaatgactcttcttcactcttaacaatcttctcaatgaaggcacgtttttcaagtacttctggatagtaactttccatgatattaccaactgtctccaccaatttgtacaagaatggctctgtaatgcccaaacgttgaccatgcatagaagcacgacgaaggagacgacgaaggacataaccacgaccttcatttccaggaagggcaccgtcaccaatagcaaaagaaagggcacggatgtggtctgcaataaccttgaagctcatgttgtcgccatcttggtcataggtcttaccagaaatcttttctacttcacgaatgattggcaagaagagatccgtttcaaagttggtcttagccccttggaaaatagctgctaaacgctccaaacctgcgcccgtatcgatgtttttgtttggcaattccttgtactcagagcgaggaacagctgggtctgcgttgaactgggacaatacgatattccaaatctcaatgtaacggtcattttcaatatcttcttccaagagacggataccaatgttttcagggtcaaagtcagtaccacggtcaaagaaaatctccgtatctggaccagaaggacctgcaccgatttcccagaagttatcttcaagcggaatcaagtggcttggctcaacaccaagggcaatccaacgattgtatgaatccatatcatcaggatagtaagtcatgtagagcttgtcttttggaaaagcaaaccattctgggcttgtcaagagctcaaagccccattcaatcgcttcatcacggaaataatcaccaatagagaagttaccaagcatttcaaacatggtgtggtggcgggctgtcttaccaacgttctcgatgtcgttggtacggattgatttttgggcatttgtaatccgtgggttatctggaatgacagagccatcaaagtatttcttgagggttgccacaccagagttgatccacaaaagagtgggatcgtttacagggacaagatttgctgaaggctcaacagagtgaccctttgatttccagaaatccaaccacatttgacgaatttgagcagaagataaatttttcataaactaagataccaagcccgattagaaggcgactgaaaaataggaaactgacaggaaatcttgatttcctaggcagtttatcttttttccgagccttccgagcgggttcaatttaacgaaacagttaaattaaacatttcctttcatatagtaataattgaggggaaagtccgtagcccgagttcatttcagaataaactcgataccctttcctttcataagtgatagttaggcgggttcaatttaacggaccagttaaactgaatgattatttcacgattaagtcgatgcatcttccatcatttcgatgtagtcaattgcgaccactaaggaaatgaccaaatctgcacaggagtcctccaatacagtaacggagtaatgagaagttaaatgaaagagttctttggagatttcagctacgagcataccatctggccttttcaagcgaaaatccaaatcccagatatttccgtctaggattaaacctagattttccacagtatagcgatccttgaaaaaagtaaattccttttgcaagtagaaagaatgtccctctaccatatcaatggtaaactggggcaggaaggtcaaaaacttcttagtaatctgacaaacttccccacctctggaattggttacgataaatcgttttggaatttcgagaaaagatccctccacttgataagcaagattcccaaaactatcacgaatatcaaatttttcaccaccaaaggtaaagcgctgtttcacttgaaattgcttcatgataacctcccccaaaaaaataacaagaaatcaaacgaagggcgaaaaaccgcggtaccaccttcattcaatgacttgtcattctcatttaagaaactgtatccacaagcaaaaaacttttatatataagccacaaactgtgaatacaggctctactattcaattgtaatattaagtagcaaaatacttggcttagatggctcgcaacaaccgccaattttctgaactaaggtgtcaagtaccaattcttaataagtaaatcgtcaattactgacctgatgaactagaagattctgttgtagaagaagaactttcagtcgacgaagagctgctcttcgttgaggaagaactgctttcttctgttgtcacatactgtgaaagaagattttggaaagcactgtctttaaccttaacgtttgctttttggagtgcttctttcagcacagtagcaacaaatgatgaatctctttgcttttgtgccaaaataatttctttcagcttatctttataatcttcccatttagcagatttttctgatttagcatccaattttacaacgtaataactcgttgtatacgtcttcatatctaccgaagaaatcaccgacgctccgacttgacctgcatccaaggcaaataccgctttctgtacctctgctggaacagttgttgaagttgaatcgaatttaacttcgcctccattgtcttttgtagtagtatccgtggaattgtctttcgccaattgagcaaaatctgcaccttcagcttgtgcagcagctaaaacttcttttgctttagcttcgtctgccaacttgatgacacgtgctgttacttcaggtgtataggcgtcataagctgccttgtagttttcatctgtcaattctttctcagcagcttgttttacagcatactcaaccaatttattggtacgaatttgttccttataggattcttctgtcaatcctgccgaagaaagtgccgcgttaaaagaagcaccaagttgttctgccttcttatcatattccttatttacttcttctgcagagactttgtcaccatactgattttcaaatacattactgataaccattgacagcaaaacttgttgagcttgtgagtttgtttttactttctcataaaactcagacacagtaatcgtgttacctttcatcgtaatgatatctttatcagctgcattggaacaagcagcgagtgttactgcagcaaagagtgttactgcacctgcgagaatttttttagtttgtttcattaaagactctctccttttttcattaacccctttattataacacaaaagcttaaaaacttcttaaatttctatatgttttaagtcaacattctctacatttttcctcaacataaggagaccgtcactcatggaaacaagactagcagtcacatctggattatccaaagtcgcatcgaataaacgttgcaatcccttataaatcgttcgctgccctcttctgatatccttgatgtccttggcaacatctcctccttggaagatgtcatccaaaatgattaaaccacctactttgacctttttcaagacttctggtaaaaatacaatatattttgatttagcagaatccatgaaaataaaatcatatgtgttatctggtaaagtaggaagaatatccatagcttctccttccagcaattcaatctgctggcgataatcatacttggcaaagttttccttagcaaatccaatcatttcttcatttcgatcaatcgtcgtaatcttcgagtgcgggctattgtcagccatcagtaacgcagagaagccaatagcagttccaacttctaaaatacgtttaggttggagtgtctgcatcagcaagcggaaataagctaccgtttcatgagggataactggaatgttttcttgatgagcaaactcttccagttctttcaaaaaccctgtattttgcgcctgacgtgttcgcataaaatccacaatttcttccttgacaaccggacggcgcatattgtgatttgcgtttttactatatgattcaaccatagaatccattatatcataagccgacaagattttcttcctcaatacactaaaaggtaggtttccccaccttttctctacatatttttggcgtaatcaattcgataccctaaatttccagctagttcttgaagtcgaataaaagtcgcctgcttactgaaaaagagatagtaactatccgtgtccatatctactgcccctagacaaaagttttcatcaagatatttgttatcaatgactcttgcccattctgaaatagatgcaattggacttaatccacctgaatccaatttaagagaaattcccgcattgcggacctgctgaaggcaatcaaaaaagtagataaaatcttcaagattgtccttataatcacgcacacaaatatagttcaaatgctctagtaattttatcaagattaaccaaagattttccttttcagactctccaacacgatccaagaaatcatcgaatgactctgaatctaaaatacgttccataaaattgagaatctcgtgtggatcactggcgaagactacttctctaagttggagaaatagttccctatcaccatttgacattaaatctgctaattcaaaaatatcttgtagttgttcttctgttaacatagtcccctctctttattaatttgaaaaatcccatcttatatgcggtgctacttgctctacaaaatggtaaatatcattaaaatctgcaccatcaagcctattcaagctgacgactgcaagtagtccccccttatttcctacaattcgcaaacgtttcgactgatagccacgatagacaggagaaaccatgtatcgaatctctgcaatctcttctaacgaatggcgttgacgttcactccaaaagtgttcttgaaattctaggtactgttttgtcaatataaaaactgccttttgctttctcaatatatataaataaactagcaaagcttgtaaaaatatcaaatagacaacacttcccatagatggctcttgcttggtcaaaccaccaagacccagcaagattaaaacaaggctaatcacactgggaatgacaatcgaacgtttataggaaatcatattagaggtgcacacctttctcaacgagagcttctaattcttccaaacgggcttcaaataccttgaaggcatcattgaggtaatcttccttggtcatgtctacacctgctttggcaatgacattgagggaataatctgagctaccagccttcaagtagttgagatagttttctttgtcttctggactaccattgacaatcttgtttgctagagctgatgctgctgcgaaacctgtcgcatactgatagacatagaaattgtaatagaagtgtggaatacgagcccactcaaactggatttctggattttcttcggcagaaagtccgtaatatttctcgtttgtctgaccgtacaattcattgaggaaatcagccgtcaagacctgaccttcctggtctgccttatagatagcttgttcaaactcggcaaattgggtctggcggaagactgtaccacggaaaccatctaggtaatgatttagaatagcaaagcgttccttgtcatcttctacttctgccaagagtttttcagtcagaaggttttcgttggtagttgaagcaatttcagccaagaaaagtgaataatggccatagacatagggttgagtcttacgagtcaacatggaatgaagagaatgtcctgtttcatggataagggtgtacatgttatccaagttatcctgccagttgagaagcatgaaggcgttggtgtcgtaggcacctcctgagtatgctcctgagcgttttccttcattaacatggacatcaatccagcggttttcgaaggcttccttcacaatagccgaataatcctcgccgaagatttccaaggtttcttgacattttttaagagcatcttcataagaaatcttggtgctgaaatctgacaatggtgtgtacatatcgtacatcttcaagtcatcaatccccaggagcttcttacgcaaattgatgtaacgatgcaagagcggaaggtgcttgttgactgccgccactaatgtatcgtaaacagattctggaatgaaattagctgcaagtgatgcgtgacgggctgaatcgtacttccgcaaacgagctttcaagttattgaccttgacattagactgaagggtcttagcgtatgtatgctggaactgctcataagtaccgtacatagcttcataggcttcttggcggacatcacggtttttagactccataaagtggatgtagtttccgtgtgaaagtggcaccaagtgaccgtcttcatctgtgatttctgggaaacgcaggctggcattgtccaagactgagaaggtttcagctggtgattcgaaaatttcgctggtcgccgccaatacttcttccacctcttgtgacaagacatggtccttagctgctaaaagtttttcaaattgatggctgtactgaacaagagccggctcttctactttaaaggcttccaatttctcttcagtaatgcccataaattcaggctcatagaaggcaaaagcctgtgaaaagacagcatacaagcccatggccttagcttgaaattcctgatattttccttcgcgagtatcttggtcgttcttcatagacgcatagacatagagtttttcaatgcgacgcataagactaagttgcgtttcgctaatttctaagagacttttagctgagtccagtaaatgacctgcaaattcttttgttttttcagtttcagcttgtaaatctgcaagttctgcttcccaggcttcatcggttgggaaaatagtggttaaatcccactggtatttttcttcaatttcgtaacgttgtttagacataattaatcctccgtattctttattctaacataaaaaatcccctctttccaacggaaagtgagggcttataggttacttatttcaactggaaaacagtttttgccattcgctatcgcaagtcgtcactaggctaacaaagtctacaaccttcaccgacagtagtatgactaacataaaatattgagcatattttcaaaagtaatatatacacctccatcagctatctctacttacattggttttctataaattataggtggatatagaacctgtttctgcttgtcttcaatattgccgtaatactggtcaaaatcctgataaactagggttaaatctttttgtatttgggcaaagccaatggcagagcggggcagacggatgtgggggtaccattcttctgccgtctttgtcagcaaattctcccctcggctataagactctgcctgcagggccaaccaattgggggatttgtaataaagctgttgagcaatgtagcgaggcaaatccctatctaacgggcaagtaagatgcgataaagcttgcttggcaaatggcagacgcaagatgtccaataaatttccctcgccaaatggaaaaacctttgtcagacagtggaccttacctcgtaagtcttcgtgaataaggtaacgaagacgcaattccttcttctcatcatccaattcccagaggtgaaaccccatattcatactaaaagagagaaattgcttgtgcaaattggtcagtcgttccttgagccacaaatccttgccaagcaaccaaagaacctgataaccagcctcactataggcttgcgtcctcagctgcaaacgagaaatgggcagaccggaacattgaacttccaaagctagactattattgacaaataaatcagcgacctgtcctatactagtcaagcatttttcaagttcaacttgttcggcattgactaaccacctgtacagacaagacttgagggacaggtgctgagcggactcattctcggaaaaatagtggcagtcccgcagggttacatgggcaaagtgcgaacgcagaacttttcctgatttgtatcggacaagtcctccacaacctggacaggaaaaactgccttgcggcgcaggattttccaagacattaaaaacttgcccatcttcatcaagtgctactaacatattacctcctttctatattagttcgtaaaaaaacacccagtttaactgagtgtttgaaattttttacccaatctgactgccgtttggcacagatggatcgactgttaagagtgttaaattgtcaccatgttcggctgataggatcatgccctgactgagcaagcccatcatcttacgtggcttaaggttggcaacgatttgaactttcttgccaaccaactcttgctcatttggataatacttggcgataccagacaggatttggcggtcttgtccatcaccagcgtccagacggaacttgagcaacttgtcagaaccctttactttggctacttctttaacttcggccacacggatttccaccttgtcaaagtcctcgaacttgatcgcagctttttcgtttttgagttccacgtcagctgggttccactctttttcttcctcttgggaaatagcagagctgccacccatttgggcttggatataggcgatttcctcttccatatccaaacgtgggaagataggcgttccttttgcgaccactgtcaaacctgctggaagacctgcaaagtcaagattttcaaggtcaaatgctgttcccaaaccaagctgttccataatggcatttgaagtggtcatcatgaatggctgaatgaggtgagccaccacacgaagacctgctgttaagtgagccatgactgctgccaacttgtcacggtccgcttcgtccttagccaagacccaaggtgcagtttcatcgatgtacttgttggtacgggagatgatattccaaacagcttccaaggcgcgtgggtagtcaacagcttccatatacttgtggtagcttgccaagttgtcagctacaactgccgccaagtccgcatcgaagtcagtcacattggcaacaaaagtaggtacctgaccaccgaaatacttgttaatcatggcaacggtacggttgagcaggtttccaaggtcgttggctagttcgtagttgatacgatcaacataatcttctggtgtaaaggtgccatcagagccgactggcagactacgcatgaggtaataacggagtggatccaagccgaaacgctcaaccaacatttctggatagaccacattgcccttagacttggacatcttgccatctttcatgacaaaccagccatgagcaaccaagcggtctggcaacttcatatccaacatcatgagcatgattggccagtaaatggagtggaaacgaagaatgtccttgccaaccatgtggtaaactgttccattccagaacttgtcgtaattaactgtttcttcctgaccataacccaaggcagttgcgtagttgagtagggcatcaatccagacatagacaacgtgctttggattggacggtacgggcacgccccatgtaaatgaagtacgtgacactgccaaatcttccaagcctggctcgatgaagtttttcataatttcattgaggcggccggctggctggataaagtctggatgagcattgaaaaactcgaccaacttatcctgatacttgctgaggcgaaggaagtaggattcttctgaaacccaggctacttcgtggccgctcggagcgataccacctgttactttgccgttttcatctcggaagacctcttctaattggctctcggtgaaaaattcctcgtccgatacggagtaccaaccagaatactctcccaagtaaatgtcgtcctgcgctagcaatttttcaaaaacagccgccaccacttcctcgtggtaatcatcggtcgtgcggataaatttgtcgtaagagatgtccagcaagttccagagctccttgacaccaaccgccataccgtcaacgtaggcttgcggagtcaaaccagcttcttttgccttctcttcaatcttctggccgtgctcatcaagccctgtcagataaaaaacctcgtggcccatcaggcgtttgtaacgagccaatacatcgcaggcaatggtcgtgtaggctgaaccgatgtgaagttttccagacggataataaatcggtgtggtaatgtaaaacggtgtttttgtcatgtttttttcctttcaaattcagagcaaatgaaaccctgttattgacaacatcctattttatcatattttcagctaaatcacaaaatggttctaactacaagtcttcctctatctatgctatactatgatacaactcaaacagaaagaggtcatctatgtttacaaagaaaaatattcttactcatctctttttcctcatcatagcagtcggactaaaacggtacggtgtcacagcacctgacttgatatggaatatgttcttggcattggtagcacttgattttgcaatccttaccaatcatacaaagtcccatatcctcaaagtgatagcaggtctcctctggctctttttctaccccaatactttttacatggtgacagacatcgtccatatgcactttgccaacacagtactatggcaacgagaaagcatgattctatttatgctttatgttccaagtattttctttggggtcatggctggcgttgaaagtgtacgacttattttctctgctttttctatcaaatcctactggctaaaactgtttatgattagtggtctttccctactatccagctttgccattcatatcggacgatatgcaagactgaattcatgggacatctttaccaggccaactgtcgttattgatgaaatgcttgcagttatttcgtgggattctctcccctttatcctcggcttcacctttatccaaattatggttcttgtcttttcaataaatgaataagatttttatctcatagccattatcttcaagcatcttcccacactcaaggactatcgttccttttgggaagatttttcaaggacataaacaaaattttttgataaatttatatcttctccgtttctctccattacatttttatccaaactgtatgaggcaaaaatcgttaacctattgtaagtaaaatttcttaaatttccttatatataaaatattcagaatttactgtaaattctacataaaatcatggatattgattttaaattcttaaaaataatggtataattgaggaacctataaatgaaagagggagatctattgtttacaccaatcagcgaaaaaattgacatcaatcaagtacgagaacattcaaaactttctccagaaacacttgctaaaaaacaagctcgtgaccgtgaacttgaagccatcttaaaaggtgaagataatcgtcttctcctagtaattggaccatgttcttctgacaatgaagaggctgtcttagattatgctcaccgcttggccaaactccaagaagaggtcaaagataaaattttcatggtcatgcgcgtctatactgccaagccacgtaccaatggtgatggttataaaggactcatgcaccaaccagatacagatgctgcaccaagcctcatcaacggaatcaaagcagttcgtaacctccactatcgtgtcattacggaaacaggtttaactactgctgacgagatgctctaccctgaaaacctgcctttggttgatgacttggtttcctacatcgctatcggagctcgttcggttgaaaatcagcagcaccgctttgtagcgtcaggcatcgatgttccaacaggcttgaaaaatccaacgtctggtaacctcaaagtcatgttcaacggtctttttgctgctcagaagaaacaatccttcctcttcaacaatactgaagttgaaacatctggcaatccacttgctcacgttattcttcgtggcgcagtcaatgaaaatggtaaatacctaccaaactattactacgacaatctcttggaaaccattgagctctatgaccaatttggtttgaaaaatccattcatcatcatcgataccaaccatgacaattctgggaaaaattatttggaacaaatccgtatcgtccgtcaaaccttaatcaaccgtgactggaacgaatccattcgtaactacgttcgcggattcatgattgaatcctacattgaagacggtcgccaagacaatccagatgtctatggaaaatccatcacagacccttgcttaggctgggaaaaaacacaagaactcatccgagaaatttacaacagataggaagatactatgggaattcacaaacgtagcaccagtttagacatcgataaagtaaaggaactttccaagttagaaggagaatttctagctgcaaaaaatcagcgcgatgaagaactgaaaagaattatccgaggcgaagatgaccgtctgctcttggttatcggtccttgctcatcagataatgaagaggccgtcctagaatatgcacgtcgtctctctaagcttcaagaggaagtcaaagataaaatcttcatggtcatgcgggtttacacagctaagccacgtaccaatggggaaggctataaaggactggttcatcagccagatacttctaaattaccagacctcattaacggaattgcagccgttcgtaatttgcattaccgtgtcattactgagactggactcacaactgctgatgaaatgctctactctgccaactaccctcttgtggaagacttggtgtcctaccatgctatcggagcacgttcggttgaagaccaagaacatagatttgttgcatcaggtgtcgacatgccaactggtatgaaaaacccaacttccggtaatttgaccgttatgttcaatggtatctacgccgcacaaaacaaacagaactttatttaccgtgatgcagaagttgatacagatggcaaccctctagctcatgctatccttcgtggtgccaatactgaaaagggcggttatgagccaaactactactatgatattctcttgaaaaccatcaaacagtatgaacaatttggtcttaaaaatccatttatcgtaattgataccaaccatgataattctggaaaaaattacctggagcaaatccgtatcgtccgtcaaaccctcatcaaccgtgattggaatgaagctattcgcaagtacgttcgtggtttcatgattgaatcctacttggaagacggccgtcaagatagccctgaggtattcggcaaatccattaccgatccttgcttaggctgggaaaaaacggaagctctgattcgtgaaattcatcaaaccgtctaattctttccttaattttttatacgataaataatttggaggtaagctatgaacattgatggttacactcgtcttgctgccgttgttgcaaagccaatcaaacactccatttcccccttcattcataatctggcttttaaggaaacaggtgtaaatggtgtctatgtcgcttgggaaattcccgaggaagatttggctgtaacgcttgaaaatatcaaacgatatgatatgtttggtatcaacctgtccatgccctataagcaggctgtcatcccttatctcgatagcctgactgactctgctcgcttgattggcgctgtcaataccgtcattcatcaggatggcttactaatcggtcataataccgatggcattggattcttcaaaagtttagaaaaactaagaggattccaagtacgcaacaagcgactaaccatcctaggtggtggtggtgcttctactgctatcatagctcaggctacattggatggtgcaaaggaaattaccattttctgccgtcaacaaagcttggaaagaacacaggcgagtcttacacctattgctcgagcaactggagttcccatgcagatcctagcgcttgatgatagccaattactacaggaacatatcaccaactccgacttactagtcaacggaaccagtgtaggcatggatgggtattctcaacctgttccttctaccattcgctttcccgaaaatcttttggttgcggatgtgatttatcaaccattcgaaacacctttattaaaactagcccaatcacaaggcaatccaactatcaacggtttgggcatgctccttttccaagcagctgaagccttccaatcctggactggacaggaaatgccgactgacttgatttgggaccaattagtccagaaatatgacatcaaatagagaggaaatctgatgaaactgaccgtcaatcttcccaacactccctacgacatccttatccaaagaggaagtttagcacagacaggtgcatgggtcaaagaactttggaaacctcagaaaatcgccattattacagatgaccacgttggctcactctaccgcgaaacagttcagtcaagcttagaacaagctggttttgaaaccattgtttttgaatttccagaaggtgaagcctcaaaaaatcttgatactgtcaaccaggcctacgaatttctcgtaaaaaatggtatgacacgaagtgatggaatcattgctctcggcgggggagtcgttggcgatttggcaggttttgtcgcttctacctatatgcgtggtatccatttcctacaaattccaaccagcctaactgcccaagtcgattcttctatcgggggaaaaactggcgtgaacaccccatttgccaaaaatatggtggggaccttctgccagccagacggcgttctcattgaccctgataccctaaaaacactcggcaaacgagaattgattgaaggaatgggcgaggttgtcaaatatggcttaatagatgatgtggagctctgggaaaccctagaccaattagacggctctgtcgagagcattctggagcatgctgactatattatctaccactcctgtgaagtcaaacgcaaggttgttgtcgaagatgaattagacaacggtgtcagactctatctcaacttcggtcacacgattggacatgctattgaagcgaccgctggctacggccaggtcatgcacggtgaagctgttgccatcggtatggtacaaatctcacgcgcagctgagaaaaaaggactgatgccagctggtatgacagcaaagattatcgccatgtgtgaaaaattcggcttgccgactacacaccagccttggaatgtagatgaattatacgcctccctaactcacgataaaaaaacacgtggcaagaccatcaaacttgtcatcgttcctcaattgggacaggctgccatccatcaaattccaatggaagaaatgctagaatttctacaagtatagtcatttagttgacttttacgtcgaagtaataaaagtcaactaatactcaatgaaaatcaaaaacagactaggcgacgcagatgcagatagaactgaagttcatcaaattaagtcaacaacgtctgattttgattttcgaagagtataaatgacgatataagaaaaaagactactgacttgcatgaaatcagtagtcttatttttttataaaatcatctcatcgtcagttagcttttcaccgctgtttttgtagaaaaggtccatcaagttttgaacagtcaagttcttcttctcttctccttctacatcgacaacaatctgaccacggtgcaacatgaccaaacgattaccatattcaatggcgttttccatattatgcgtaatcatcagagctgtcaactgatgactttccacgattttcttggtcaattccataaccatatcgctggtttttggatcaagggccgcagtgtgttcgtccaggagcagaacttttggtttaaccagcgaagccatcatcaaggtcagagcctgacgttgaccacctgaaagaaattgcgtgtccaccttcatacggttttctagtcccagaccgagctctttcaaggcttccttaaaaatagcacgttcactatctttgaccccccagccaagaccacgtgacaatccacgacgataggcaatagccatattttcttcaatggtcaagcgagaagctgttcccatcttaggatcttggaaaacacggctgatgtccttagagcgtttggcagctgagacatacttaatggatttaccttcaagcaaaatatcgcccgaatcaaccgtcaaggcacctgcaagtgagttcatgaaagttgatttaccagcaccattaccaccgatgatagagataaaatcaccttcttttacatctaagttcaacccacgaaggacatggttctcattaactgttccagcttcgaaggttttatgaatattttggattgataaaattgtagacatgacttcctcctaagcatttccattcaattttggacgacgaatattcaatttcttctgcaattctggcacatagagaacggttgccagaaggatagctgagaagagtttaacaaggtctgcatccatacctggaatttccaaaatcgctaagataatcaaacggtaaacaactgcaccgagaacaaccgataggagtctccaacccaagcgtaagttacgcaagataacttctgcaataatgacagatgctagaccgataacaatggtacctgtaccagagttcaaatccgcatagccattattctgagtaagaagagcaccacaaagggcaattagaccattcgacaacatataaccgtagattttcatattatctacattgataccattggcctcactcattggaatattatcccctgttgaacgaatagctagaccaatttgtgtattgagcaagagcgtcaataagcctacaactgctagtacaaagaccagaccaatcaccaaaacagcatttgtttttgtcaaaccaaaatcctgcaattgggtcactagagtttcttgcttaagcagagccacattggctttgcctaagattttcaagttgatggagtagagtcctgtcaaggtaacaataccggtcaaaagggctggaatttttagttttgtatgaagtaaaccagaaatcaagcctgcacccataccagctaccatagccataaaggttgccagcaagggattcactccgttcacaatccctgtcgcacaaacagcagctccaagcggataagatccctcagctgtcatatcagcaatatctaaaatacgaaacgtcaagtaaacaccaatcgccataactgaccaaagcaagccttgcgagatacttgataaaataatatccacgattttctcctttttctaaattcgtagtcaatactaggttctatcttaccgatcttattcagatacagcaagcttagaagtatcgatacctaatttctgagccatttcttcattaacgtgaagactgacggtctctgggtattctactgccgtttctgacacattggctccttcgataatcttaatagccatttttgcagtttgacgacctaaagcttcatagttggtaccgtaagtcaaaagacctccttcatccaccatgtccgttgaaccaccgattactggaaccttatgctccacagataattcaccaatcatggtcatggttgaagcgacagtattgtctgttggaataaagagagcatctacatccttcatcaagctagttgtcgcatcttggacttcatttgaagatgtgattccttttactactaccttataacctgctttttctagcaattccttagcttgctctacctggacttctgaattccgttcgctagtagtgtacaaaataccaacggtcttagcatcaggaacagcttgtcctagcaattcaacctgtttgtcaattggagcttgatcagatgtacctgtcaaaagtccacctggtttttcaatggattctaccaagtcagctgacaagggatctgtaaccgcagtaaagacaatcggcgtttcagtagacacagtcgctaaactctgggcagacggcgtagcgattgccaagacaatatcatttccatcgattaattgttctgaaatggtttgaaggttagcttgatcgccttgggcattttgataatccaaaaccaatttttcaccctctttataaccatttgcttctaattccgccacaaaaccctcacgggcagctgtcaatgattcatgctccatatattggagaactccaacttttaccacatctgaggaagcttgttctgatgatgaggaacaagctgcaagtgttagcaaacccatacttgctactgaaatagttgccaatttttttactagcttataatacataaacgtttcttctcctaaatattttactcttctaatgcttttatagtcgctgcatcaataccaacagctttagccatttcttcattgacggtaatagccgctgtatttggtttttcaactgctaagtcagcaggcttttcacccttcaaaatcttcacagccaattcaccagcttgaacaccgatagcatggtagtcgacaccgtaggtaaatagagctgcgtcaataactgccgcgtcacttcccatagctggaacttttgcttcttttaaaatatcaccgattgttgaagctgtagaggcaactgtattatcagttggaagatagatagcatcgacttttcctgcaagtgaagtaatagcttgctgaacatcgtttgtcgtcgtaactgttgtcacttctacttttacaccttttgcttcgagtgcttttttagcctgctcagcttgaacttctgagtttacctcgctagaattgtagaaaataccgacagtcttcgcagttggtacaactttgagcaacatctcgatttgaccttccacatcagttgcatcaatcgatcccgtcatggtcccacctggtttttccaatgattcaaccaaacctgcttcaactggatctgtgacagctgtgaatacacttgatgtttcactatctgcattaagcatggtttgggctgccggtgttgcgatggcaaagttaagatcattttttcctgccaatttctcaaccattgtctgtaagtttgcttgatcaccttgagcattttgcaaatcaatcgtcagattttcaccttccttgtagcctgcttcttcgagcgcctctacaaagccttcacgagctgagctcaacgcttcatgttcagcatattgaataataccaacattgactgaacttgaatctgacgaattggaactacatgcagcaagcgttactgctgacaaaagtgctactgaactaagtataatttttttaaatcccatgattattctccttttataaatataatagcaaacaagaaaggaccgcttagactacactctaaacggtccttatatttcatctgtataggaaaacagaatgaattatccgtgccatttagatgtatcatctatgaggcacatgtcaaaatagctacagccacatagatacaaactttacgttcccgtgtttgcatccatgtttaccatgtctacaaacactatctaaaatagccgtagaaataagtatgattagctgaatgattttgacacatttgtaacatctctgtttccctttctcatttatttgtaactatcataactgttttcaaattatttgtcaatagggaattgcgtaaattttcagatttttcaagttttttcgaatttttctaaaaatagacccctatattattagctataaaacgacctgtcatcttgtttatatagccttttagtttacttttagtacttgctccaactatttcacaaatagtcagaggttggaaataaggggaacaaggtttgcgtcaacaaccgcagctataactgtttctgggattgcttgcacagtaaatggactgttcaaggtgagagatataagagcggattgcaaaaccaggtcaacatcgactgattttgattttcgaagagtataaatgactatatttgatgttacaaaaagtctgaacctaagcccagaccctactaaaacaattattttacttcaactttttcagtccaaggacgcgctgtaattgctagaacctcgtttagttcttctacgttgcggcggccttgatccgccaaccaagctttggctgcttcttcaccctcgcttgcaaagatggctactgcatccttccaagtcgcccgaccacaaagaacaccattaaagcttgaaccagcttctttggcaaagacaagggtttcttggaaaagtttagcagatacgccagcgctcaaataaatgaatggcaagtgagtgctatctgtttgttccttgaagaaggccttagcttcctcaactgtatagactggctcttcatctgtgtaaccttctacaaagttcatattgacaggtacttcaaccttgagcacgtcggcattataacgtgacttactaaattcacgcatggcaccattgaccttgtgtggtttgagggctgcgtattcacgagaagtcacatccatatcgctggcatcgtaagtcaagatttcgacgaagtaaggaatatcttctgcgatacactcactaccaatgcgttctacccaagcatgcttaatgtcgttgatttctggcttgtcatctacatcatagtaaagcaagatttttacggcatctgcacccaattctttgatacgtttggctgaccaatttggcaaaaggtctggcaaacgacctggtgtagacgcatcgtaacctgttttttcataagctgcaatgaaaccgcaatctgcatggcgcaattctgaagccggaacgccgtattccgcatccaagagaatggagcttgcataaggagtcaaatcgcttgagatgactttcttgaagtcaatcaaaatgtcatctccaaattcgccaccacctgctgcagcagcaagcaagcgtttcaaagccccccgttggtcaatcgccaaagccgcaatcacctgatcgctgtttgacaagcgagtcatgtgattgaatttagcctgagaaagttgtaattttgtcattagtttcctcctaaggattttattaaccaaatcgtttcacgccatctagataggtcgcttgtaagcgtcctgcatcatctacgacgataaagtctgcagctcggccttctgcaatccgaccacaaatatggtcaatattgacagagcgagctggtgccagagaagccatacgaagggcatcaggtagggataccaagccccatttcacaacattctgcactgcttcaatcaattctaagatagaacctgccaaactaccactttcttttaaacgagcagttccatcttttacaacaacttcaaattcaccgaggcgggactccccttcacccataccgccagctcgcatacagtccgtaatcaaaacagtttcctcagctccacgtgctttgaccacgatttctgccgcagctggatgaacatggtgtccatcacaaatcatttccgcatagacattttttaaattcaaagcagcaccgaccatacctggttcacggtgatgaagcccactcatcccattgtaaacatggacgaagatattggcaccagcttctactgccgcttccgcttgcgcataggtcgcatcgctgtgagccaaggcagtatgaattgccttgctgttagcaaactcgatgaattctttgacgccttcacgttctggagcaatagcaattttattgactaaacctttagataagctgtgccaattgtctaacttttcaatggatggatcgctcatgtacttaggattttgtgctcccttgtatttttctgtaaagaaaggaccttctaagaaaataccttgaatcttggcgcctgtttcctgccctgcataagtcccaatcgtttcacaaactgcatctaaattttcagtcgtatctgttaatgtcgttggaagccaagaggtcaccccacaagacaagagaccttctgaaattaccttgatcccttcaaaatcattgtccataacatcgtgagaagcgtagccgtggatatgtgtatcaactagccctggtgctaaatgaaagtcagaataatcaacaatctccccttcaggcttttcaatcacaatccgtccaaactgacccttgtcagtaatttccaaataggctgattcgacctcactctctggtaaaataatagattttgcttttataaatactgtcatattatctcctttattgatatatatacttatcaaactggttataaccatataccaaatatattgtagaacttctattagaaaatgtcaagtaattaccataactttataagaaatggatgctgtgagaaggtagaaaaaagagttcttactgccctaagtaccgtttctgaatctgtacttggagataagaactctacgtaagcagtgtatactaggcgtcaatccatgacctaacaccctgctcctatcaaatataaatatattacaacaattcgttgagaggcttgaagatgatacgttccaaatcagctacataagttcccaactgttgttgcttgctgaaatattccgtcaaaagtggatttccctgaactttcttgttgaaatccaacattttcttttggtcagcttcagtaggaatttcaccagcctgcaatttagattggatctctttttggaaagaaatataactttccaatatttctttggcttctgaattcccctcaactgagaccttaacggcttccaccgccttatattcaggcaggttacggattgcacgttccaattcatttgcgatatcatagatatttgttgacatatttttctcctaatctaaatggattttgtaagtcgtctgctctcttaaacgtttcgcagcgtcttccaaatttcccttgtttttaagcgtgatttgtaaaataccgtgtatatcttcacggttctcttcattgatacgaatattgacaatggaaataccccgtaagacttccaaaaccttcaaaatcgtatcttcctcatcaggaacactaaggaataaatcgtagaaagaatcaacacctgcacgcttgtgaatttccatggctttacgagtttgacgtcccttatcaaaaaagtcccaaattgctttttgatcgccagatctgagaacatctgaaatttctgaaagacgtgcttgaaattcctcgattcgatttagaatagaatctgcattggttagcaaaatgctagtccacatgctcggctcactttccgcaatccgtgtcatatctctaaatcctccagctgcaaaattattcgtaaagggatgatcttgagcatactcaccagcttgatgcatcaaactagaagccaatacgtgtggaaaatgtgaaatttgactggtcacacggtcatgttctgctgcatcaatctgaacaaaacgtgcccccgttccagataacaagtctgtcaatcggggaaccgcatcctgcttggtagcctgacacggtgtcataatgtagtaagcattctcaaatagatggagatctgctgcactggcaccagatttatgactacctgccatagggtgtccaccgataaaattaatttgtcttggcgccaaatgttcctcagcagcagccacaattgcagacttcgttgaacctgcatctgtaatcaagaccgtatccttcaattcaagggcactaaattcttcaatcaaacgcaaagaaacttgaattggaacacaaagaagaatcacatcagcctgctttgctacaccctccaattccgttgatacctcatcaaccatccccttgcccaaggcaatttggcatgattgttcgttaggatcaaagccaatgaggtgatagtctggatggtctttgcgaatacagagcgcaagtgaacttccaatcaaccctagacctacaattaaaatcgtttttttcattaattacctagaaatttttgacatagtcgcgatgactggctaccgcagctttcaattcctccatattatcggaagagaacttctctaggatttctgtcgctagagttgtagctacgactgattccatgactacaccagctgctgggagagccgttggatctgaacgttccacagtagctttataaggctcatgagtatcaatgtcaaccgacatcaatggcttatagagggtcggaattggtttcataacaccacgaatgattagggcctcgccattggtcataccaccttcaaaaccacctagattattggttcggcgtgtatatcctttttcttgggaccagagaatttcgtccatgacttggctccctttgagataaccagcttggaagcctactccaaattctactcccttaaaagcattgattgaaacaacagcctgcgctaattttgcatctaactttttatcccattgcacataagaccccaagccagctggaactcctccaacaacagtctcaatcactccgccaatagtatctccatctcgcttgatttgatcaatataggctttgatttcttcttcacgctcttggttgacaatggatacttctgactgggctgcacgctctttgatttctgctacgcttaaaccatctgggacatcaatttccttccctccgaaaacgactacatggttagcaatttcaatatccaactcagccaaaatccgtttggcaaccgcaccaacagccacacgcatagttgtctcacgcgcactagaacgctccaaggaattacgcaaatcatcaaagcgatatttcataccaccaactaggtcagcatgtcctggtcgtggatgtttgatacgacgcttacttttgagtttctcttcgatgtcctcaactgccataatatccaaccatttttgatggtctttgttggtcacattcaatgtaatcggggcaccggttgtcttaccgtgacgaacaccagctgtaatctctacgcgatctgtttcaatctgcatacgactaccacgaccgtatccaccttggcgccgttttaactcttcattaatatcctcggcagttaaaggaagacccgctggaactccctcaataatggctgttagacgtggtccatgagactcaccagctgttaaataacgcataacttaattctccaaaatttccagaaacttacgagtattgcttaaagacatttgtcctggtgcagatgtttcatctaagctggcaaaagtccagcaggagcctgtaatcacacctgcaatacgtgttaacttccctagttcacccatggcgattgtcgcaaatatctgctcagtgttcagtgatttaaaaccacgagtataattcataacatctaggacatcctgctctgtcttagccattacagccattttaacaacagctggtgataggctagtcagttcagacatgatttccatataattagacggtgtttcttcaaaattatgataactcaacacaagattaggaaactccaacatctgctcaaaaaccgacttataagagtagtattcaaaatcaatataatctggctgataaagcgttgctacttctttgattacattgacatattcttgatcgtccaaatccaagtgaccgccttcacgtgttgtccgaatggtgaaaactacttccttaccactacatttttcaaatatagcaggtgctactcttaaaatatcatctttcagaagatagtctgctcgccattcaacaatatctgcctctgctaaacgttctacatcaatggcctctacctcttccagatttctaggcataataggaactactattttcatttatctacctgtatcgtaaagacctttaggtaattactactttcatcatttttattgattacaaaatcggctggcaagcgataagttgcctcatagcgatgttttctaacatcaaaccctttttcaatctgccgcttaaatttttcaacagaaacatttgcggcgttggtcgaagcgataatagttccacctgtatttagtatttccaaagattgagaaatcaacttgtgataatctttggctactgaaaaggtttgtttcttatttcgtgcaaagcttggcggatccaagacaatcacatcataagttaagcctttacgtttggcatatttgaaatattcaaatacatccattactacaaagtggtgattatctaagtctaaactattaaccttaaagtgagctttagaaagttctcgcgagcgtttggctaagtcaacagaagtcgtttcctctgctccgcccatggcagcagcaatagaaaatgctgccgtatacgagaacatgttcaaaagtgacttgcctgccgccaggccatccaccaaggaaccacgtacctcatgctgatccaaaaagattcccgtcatcagtccatcattcataaagacctgatagtgaactccattttccaacacagtgaaatactcaggggcttcttctccataaagatgagcagactcaaaggccaaacctttaaaacgaatcttctcataagctcctcttacttctggaaatacctgttgaaatgcagcaacaatcatctctttgacagaataaataaaggtattataccatgaaaaaactgcgtattcatcatacaagtcaaccgtcattccaccaaaactatctccatcttgattaaataaacgaaaagcgttcgtcatctcagattgataaaaatgttgacgtttctgtttagcatccacgaataatttaacaaaaaaatccatggtcaagtcttgattgcttctactaaacagccagcctatccccttattctgtttggacaaataagcctgacccaaatagcttccagactctgaatacaaaacagccagcctgtcttcatcaaatgaaacacctgaaaaatcagcgctatccaagagttgaatccctctgtttattttctgttctgcaatacggtttacctttattttcatagaattattataacatgtttcttcatatatgccaaaaaaactctaaactttgaggcttattttagaattatggtataatgaactaaacttttagaaaggaccatgaggttttattgtgaaaaaactaattgactatgtcaagaagagcggacagactagacttggtttcgtcttgattttgctaatcatttactggctcaaaacactctgggcctactatgttgatttcaacttagatacacaagggtttttccaaaattttattgctattatgaatcctctaccagtcgggattttattactcggtctctcgctttatataaagaatacaaaagtcttctatagcgtagcgatgatcatttatattattctttccgtctggctcttttcaaatgcagtctattacagagaattttccgattatatttccatctctactataatggctacctctagtgtatctgctggattaggagaagcagctcttaagttatttaggctatgggatattgtctattttcttgattttatcatttttggaatcctagtctatcgtaaactactccggtgggataaaaaaacatttcataaaaaatctagctttgctattacagcactatcagtcatgcttttctccatcaacctctttttagcagaaattgatagaccagagctacttacgagaggattttctaatacttatatcgtcagagcccttggtttacctgctttccttggttacaatgctaatcaaacctacaatgcccacaagaatcgttctggagcatcagctacagatttggagcctgtgaaacaatatattacagaacattatgctcaaccgaatgacaactacttcggtattgccaaagggcgaaatgttatctatctccacctagaaagcttacaacaatttgttattgactataagttgaatgtcaacggtgtcgagcacgaagtcacacctttcctcaattctctgtatcattctagctctactcttgccttttccaatttctttaaccaagttaaggcaggtaagacctctgatgccgaaaccatgattgaaacctctctttttggactcaatcaaggctctttcatggtccaatatggcggaagcaatacccaacaagctgcaccatatattctctctcaaaatggaggatatacatctgctgtattccacggtaatgcagccagtttctggaataggaacaacacctataaacaatggggttacaattacttctttgatcaatcctatttctctaaagccactgctgaaaattcattccaatacggtctgaatgataaaatcatgttcgccgactctatccaatatctggaacatttacagcaacccttctataccaaatttatcacagtttccaaccactacccctatacaaccagcttgattggggatgagattggctttccattagccaatacagatgatgaaaccattaatggctattttgctactgccaactatctcgatgcgtccataaaggcatttttcgattacttaaaagcgactggcttgtacgaaaactccatcatcgtcctctatggtgatcactatggaatttctaattcacgtaatcctgacttggcaccgttgattggaaaagattctcagacttggtcagattttgacaatgccatgatgcaacgtgttccatatatgattgttgtacctggaatgaccaacggtgggatttttgatacctatggtggtgagattgatgcacttcccactctcgaacatcttttaggaatcaaatccgataactatcttcaagttggtcaagacctactttccagccaacacagccaaattgtggctcttcgaactgctggcagttttatcacaccaaaatacactagctacgaaggtaaaatctattatacagaaactggtcttgaaattacaaatccagatgagacaactcagaaagaaattgatgcaattaaagaagctactgcagcacaactggcgactagcgatgccattcaaactggtgatcttatccggttcttcgacaatggattgccagccttggatccaagccaatataactacattgactcattggctgccgagattgcactagagaataaacttggcaaacaatcaacaagtttgtatagcacaaacggcaataaatcaacaattgaactatttaaagcaccaagctacctagaacttcacggtagtacaactgctaccagtacaccaaatactggtacaagcactagctcaacaagtaccagttcaaattcacggtaatacactataaaaggcttagaatcatgtcagttactacattgattctaagcctttttatactcaatgaaaatcaaaaacagactaggcgacgcagatgcagatagaactgaagttcatcaaatcaagtcaacaacgtctgattttgattttcgaagagtattagaccactatttcaaatcactcatatctatttcatcaaggaaatataaaatcctcactaggctcttcctctgttgatgattttttagggatatctatgggagcagcagtactactttcagttgcttttgtatcttctgttgtagtttcagcttctgttacagtttctatatctgtcgcttctggactaggtgtcaacaaatcatctaaccagctatctgcgtcctcttctccattagggacatctggagtattcgccaatggattcccaggcaaccaagtatcacctggctcaactgtcccatctttgctatcactttcaactttatcgaaatgaatatcgtagacagtatcttccaaaataggtgtatcccatgctacatttggaataacaggttttgtataatctcgtttataacctgtatcactcttcaaagatggcggaaaaattccagcttggttcagtgttaacccttttctaacaaggtaaacaactgttttactagttcccaaatgtgtctgaagttgaccaccttcacctgctcgaaatgcgagggctacataattctttggatcatgccaatagtaatttggatgtctacttgggtcattgatgtccgttggattctccgtattgttagcaatgtaaggtcctatacgaggagccgttgtcccaaatgctgccaagctcgttgtggcactaacataatctgtatctttttctccaccagtaataactgtcctaaactcaatgaactcataatctttgcttgaaaccggttctggtacaacaagtccttgctccttagcttgtttccaagttaagtcagatttcacaaagtatatgaaccctgctcgaatctcaccatttaattttaaacgaccattggctatcgcactatatttaacaggtacatagtctgataaatcaatatttgaaacatcatcacttggagtgtaaatatttttggttggcttacgataaacattatcaaaatcagcataaaaactttgatgttctcttgccatcttgccagactttggcaaagtagcattccaaccgttaaagacgcgtcccttttgttgaagggtctgcggataggcgatgttcaaatcctcccaatttaaatctttacgaaccaaataataaactctcttcgtttttttaccattaacgacaaaattaccaaaatcactatttgtactgaatgttactagaatgaaatttttaatatcctgaagaccttctggacgatacttttgatggacaccattacgtgttaaattttctgttgaaccttctgtataaaaaggtccatatactaattgtttctcaatagcaagatttaccgtttcagtcttaacatcacgctcaggatcatctggcaaactaggatcaattttataaacgtgcgcatggtctccatggcgtacactcatatagttcccatcaattgtaatgtcctcacgttttactttaaaacgctccatgtactgtttaatgagacgttcttttctctgttcaagagtttctccatccttttgtttaagaatacgatcttccggactttcaaatggcttcgttgtatcaatttcctttaataaaacaatatgtgtgtgatctccatgcggatactctaatccaatttgaccgtcaacgatgactttcttaaaacgtgatggctctaaattcagttcttttgctaagtagtccaatttggtttgatactcagtattttctacctcaggttgtgccttcttatccgattcaacatttggtttatactgattcacaagataagaccatttactccttttcaatgtttcaaaatgaataagatgcaaatgtttcccatgccttactagaatcccggtttccgttacaccgctgatattttgcccatcaaacaagaaaccgtcactcgtttgaaaatcaatccccggaatcccttcctgttggtgaacgataggaagagttggcgattgacgactatcagaggtcaattgtctgtgtgtcgtgccacctaagcttgattttaaaatatagtgataatgatccccatgccgaacagtatagccattggcatcctctgcgacaatatctttaggatcaaaaacgtattcatcttcgatctgtttcgagcctgacgataattgacttctcttaggttgagaagaatgatttttttcttgatagttttcaggaattaaataagcccattttgtattctttaaatctgaataaaagaaaaagtgcttatgatcgccatgattgacaataattcctaaatcagttttttcctcaatttgtgactcatcagtgagtaaaaaaccatcatccgtcgccttatcaatccctggaacttcctttttcgaatctgaaggaatctcttttgattgctttgattgcgatgtttctatgcttgttgttttttgatggttcgattgctctctatagttagacgcttgataagtaaccaatgctacagcacaaataagcgatgctcctgctacataaagcaaagtcttaccttgtttcatatctatgtttctctccttatttaccattattatattaccgacacgataaatgtaatcaactattgtaaaatagcatcaccacatccacttattatagtcttttagtttacttttagtacgaggcaatgagccgcaggcataactgaagttaggcaaggcgagttgatgaagtaacaaaagcaaaactaaatgacgataaagttaaaaccgtcgatttatttactagttaagtatatcactcatatcgaaatttagcaagtagtgagctactttccaaaaataaagaacctggttcatcactaccaagttctttacatttttatacttatttagcaagttttgctttagcagcatctgcaagagctgtgaaagctgctgcatcgttcactgccaagtcagcaagcattttgcggtttacttcgatttcggccaatttcaaaccgtgcatcaattgtgagtatgacaaaccgttcatacgagcagccgcattgatacgagtgatccacaatttacggaaatcacgttttttctgacggcggtcacggtatgcatagtagtaagagttcatgacttgttctttcgcagtgcggaacaagagatgtttagctccgtagtaacctttagctaattttaaaatacgtttacggcgtttacgagaaacaacgccacctttaacacgtgccatttaattttcctccaaatgataatctaaattctagtaagtcggcttatttcaaacctgtaagcattgatttgatacgcttgaagtcaccagcatgtaccatacctgctttacgaaggtgacgacgttgttttttagttttaccgtggaaacggtgtgaagtataagcgcggaagcgtttcaatccaccagaacctgtacgtttgaaacgtttagctgatgcgcggtgagttttttgttttggcatgttaattctccttttgcttaaaaagcttattttttatctgaagctggggccaattgcataaacatttgacgtccgtccatcttagcgcgttgttcgataatggcaatatcttgggttgcttcagcgaactcagctaatactttcgctccaacttctttgtgggtaatcatacgacccttgaaacggatcgaaaccttaactttatttcctttttcaagaaatttacgggcatgacgaagttttgtctcgaaatcccctttatcaataactggacttagacgcacttcttttacagtgacaacactttgttttttgcgttgttctttctgtttcttctgatattcaaatttgaacttaccgtagtccataattttcgctactggtggtttagcttggggttgaatcaatactaaatccacgttggcgctatcagcaatggcctgagcctcattgagtggtttgatccccaactgttcaccctcaagaccgataagacgaacttcacgcactcggatttcatcattgatgaacaaatcttgctttgctatggcttttcacctcattttatatttttcgagaaaaacgaaacggacttgctaaacaagtccgcactacaccattattctttccgaagaaatcttaatccgtagagccagacaacgttagtcgcaaggcgagaagttctcacttctgcttttctcaatacgactattctaacatgtctaaagctacctgtcaagaatttctttcgctttttcggaaataaatttcactacaccttcgatagatactcctgttgtatcaaaggtaatagcatcatctgctgcctttaaaggagaaacttctcgattggaatctttatagtcacgagccgcaatctcctctttcaaggattccaagtctgtctcaatgccacgttccgtattttccttaaatcgacgaagggcacgctcttcaacagaggcaacaaggaatattttgagttctgcttgcggcaatacaaccgtaccaatatcacgaccatccataacaatcccaccagcttgcgcaatgtcctgttgcaggcggaccaattcttcccgtactagaggaagcgctgctaccgctgatacattatttgttacttgattatctcgaataggcaaagtaacatcctcatcaccgacaaaaacaagttgctgaccgttttcatcccgcccaaatcgaatgggatactgggcaagcaagtccacgattctattttgatctgtgacctctatgccgtttgtcaaggctagataggtagccgagcgatacatagctcctgtatctaagtaagtatatcccaaatttttagcaataattttagcgaccgttgactttccacttgaagctggaccgtcaattgcaatttgaattgatttcataactcctctttatctaatacgaactacatccccaggatgagcaatccaagaccctgtagtcattttctctggattcaaacgctctagctctgcaattgaaatcccaccacgagcagccagttgtcctacaccttcacctgcttgaacagtaagggtagagccatccgttgcttccgctgggctagaacttgtttctgtttctgtcgtgtcagtcgaagtagattcttgtgtctcagcagccgatgaagagctctctgctacgactgttgtagtgcttggggtataaaattcttttgttgaatctgttttactaccgccaccgattgagagatagacagccataattccaataatcagtacgataacaaagaaaataattgccaaaactgtaaatactgttgtattcgctacccccttactcaaacgttctttacgactagttgtttctgtgtggtaaacttcttcattccatggctcttgtgacattattgagaaaactccttgtatttttattaaaatatgattacaatactaatatgaaagtaaaacttattcctgaacggtgcattgcttgcgggctctgccaaacctactcatctctattcgattatgatgacgacggtatcgttgttttttcagacgactcacaatttgagaaaacgattgaacccaatccagatattctcaaagccatcaaatcatgtcctacaaaagccatttcagcggattgatttggctttttttgtataatactcttcaaaataatcctgttttattaaatggtctattaattcaattttacccttgaagcaactatgaatagctaaatggttaataaagtatttttttgtccatttacgcatataatacattcgtccgttgggaaattcttttgcaaatatacgaatggctaaataagaaacttcaattttttctatggtagcaatttcaattttctgcactgcaaaaggattagccgaagcaatccgtaaatgctcatcttttatctcgaaatagcgatgtaagccgagcactactaatacagcaaagagtgagacaagtagaataaataatcttgaaacttgcaacttctccaataaaagtgccataccaataaaaataggtgtgaaggtaagtgaccagtatatgatggcccatgataaatccggttgccaatggtaacgaattttaccaaaaattttgatcatatcggacctccatctattattctagcacaaaaaaagagattttcctatgaaaacctctatcttttgaaattttttattacatttacatgacaatgttgaatgttttgtaatttttctgaaatgtttttgaaatattttgagtaggaattgatgggaatacaatgattggtaactaaaatattttaattattcgtctcttgactcttaacatagtaactcaggagaaacttggcaataaactttggccagaacaacaaatacatttcatagtcttcttgtgtacgaatattgttttcaatgctatttgtcgtctcagattcctcatggatacgatgatacatcaaactctcatctacaaaggtaaagctcccatttttttgtgcaatctgataccaagcaaaccaatcaagagaaactttcatttcttcattaaacttgaaatcattcagtttcttcaaattataggtcacagctggacaagaaattggattaccaaaggctaaaaccctattccgccaaaacttccatttgggaaacatggccattgtccgtaacatgagttgcttgattttcaaatttgaagttaagggaatagccacaccttccttaacttcctggtaatctgaataagcaatcaacgtttcctctgtcatctgagacattattttttcacaatagtctggtaaataaatatcatcttgatgagcaattgtagcataaggggttgttacaaaagagagtgccaaattccaatcttttccaatacctcctccttgtgcggtatgcattacgattgcattcttttggcaaatttgttctatatattcactcggagtactagtgtataggatgagttgtgattgaagtgtttgctgctttaacgaatggatgcattcttctagatacttactatctccataagcacagataacaaatgtatggttattctgcatgatgctcctccaattcagagattctttttttagccattgatacttcttgaattaaatttttaatctgctgcttttgttgagataaagccatactatgcaaaaatccaattaccaagagaacaaaaattgccacagataacaagaaattggaagtcagaccaaacccgaataagtaggccaatttaataggaataacatcaaagagtgcaaaaacaatcagtccgaagccaataacaatccacataaaggcatgttcgaataagatcttatttttattaatattcctaaaaataaaatacaaaaaacctagcgaggcaagaaacatagctaatgcttgtatagtcattattccccctccttcataagcgaagcaatcaaaatagatgagcaaacttctaccatgtagcggatggacttaaatggagtaatcgaagaaacccctcccgctctttcaaacatattggccggtgcttctactacttggaaattttgctttagtaaatgaacagttgattccggttccggatatttaattgggtatcgttttgcaaattgtgcaatcacttttctatttcccaaacgataacctgatgtagtatcccaaattcggtttccagttgttaatttaatcatatttgaaataacacctatcccaaatcgtctcataaagctagtttgaaattccgacaaagtatcaccaacaaagcgtgagccaatcaccatatcagcctgaccaactaagattggctgaattaagccatttaatgaacgaatgtcatgctgaccatcaccatcaaattgaactgctacgtcatagtcattgtccaaggcatatttatatcccgtctgaacagctccaccaatacctaaattttgtactagatgaacagcatttaatttattttgaatcaaaatttctttcgtgctatctgttgaaccatcattgatgacaacataatccaattggaaattcacactatttttataatctataattccctgaacagtttgaaggatactttcttcttcattgtaggcagggataatcattaatactttcattttttctctctaaaactagaattctatataactttttagattctacttactcatttgaagaaactataatatacatctttcagcatagctatcctattattcattaaagtcgaagtttatgtctgatttttgtcgccatattgctgatcaatcttgcataacgctccaatcttgttggacgcatatttaaagtcagtaactcttttatgtgacttaaatttgtattttggtgtccagtatattctaagtgattgatgccgtccagtatttctttataggcaacttccggtgtatatagagtacgtaaacgttccacatcaagccgagccctatctgaaaaatttctaaaggattcaatcacttgctctaacttagtcaccaactcttctatatcgcccaatttataaatttgacctgctgagaatatttcaaatgccgtcaaatgtcccaaattatttgatagaattactggaagccctcttaagattgcttcaacatagactaagccaaaagtttccatagatgaggggaaaacacagatatctctatcagttacttcctcccaaggattatctaagttacctaaaaatttaacatttttctgtaatttattttcatggatatattcatcacaaatagctttgtatttactatcccatcctccaataaaaaccaattcaatgtctaatctatttagtgtcttatatgcttttataagttctaattgattttttccttctgttaatcgaccaacagaaacaattctaacttgattgcctttttttaaaacttttgtttcttgctcagtataagaaataaacgaatggactttcttattaaatagtggtgttaaaaaattatttaactctccagtcacactaaataattctgaagaatactcttctatgaagtcaattttatcagcataataagcaaactcatttttaggaaattcatgaattagccagaaatgaggaaccttttgacatgaggcagcaattgctccttgaaaaacattaacagtatttgaaataaccaagtctatctcattttgctcaataatttcagctatgtcttgaacattctggcgatagtagcttgtggcctcttctctattaaggatttctccacctggtgcatccggccaccaccacttaatagttggcaaatagtaattcttaacccctatcattttataaagttgctcatgcttatcttgtggttcccctcctattgcatgagtaacatttataactgtgtgtcccagttgaataaggtacttcattagataataaatagacttctccgcaccattatccatactagtcgtaggagaaataaacaaaatacgtttcattagactaactcttctttcaaaaaatcattaattctatttgctgtagtgcaatgattcattacaaactcaaaagcattttctgctatttgtgctctcaagtcttgttcaagaatcaatctctccaatttactttcccattcgttatcatctgctagaactccagtcactccatcttgaatcatctcttcaaatgctccaagattacttgcaactgtcacaactttaactgctgccgcttctatccatttaatttccgactttgcttcattaaaggttgtggttacaagcggcgccaagttaatatcaacttgtgaaattaaaattggaagctttctccaatcaacatactcatgactcacaatctgttttttgaatttttggaatggtttcggaatgtctaaatatcctactatatgtaattccacttgcgggtacttttgaagtagatttagcaatgcttgactaattaaatcaaaattttcgttgtgtgtaattgaccctgagaaatatcctattttaactttattgtcgttcgaatttttcttaacttgtaaactacgctcaactaattctttagacatgacgttgcgattcaaaataaccttgtttttatattgttcgagctcgtctttcaatttcgaagtcgatgtgatagcataatcgcagagagaaagcatttttttgtaagctaaaacacttgtatcatagccttttttctctctcttgctcaaaccttgggtaaattcaagttcatctgtaaattttgtatcaaaaaccaaatcatcaatatcaaaataaacaggtctgttctttatgtgtgctgccctacatatttctttcagcatatcattgaatggagcacgataaataataatatgactagcaaactgtgcatcctgaagttgtacaagagaattatttatcactcgaactgtataaccaagttctcgcaattgctcagccttatttaacacacgataacgtgtacattgtggaataatattttcgacaccatcaataatcaaaatataagattgattttctctagttttaaaatcttctaatatagaagacaccacttcgatcggatagtctgtttccttagcaatatactccatcaaatccggaatctcggattctctttctaaaccatgccaaaaatattgttctctgtcataatttctaaaggccgaatacttaactaatggacaaccttgttttaataatttaaacggatgaatatacaatgcactatctttcgtgtctttaatcaatgcatcatacttaaagcctcgatcataaaaatattttgcaaacacagtttcatgttttccaattgccttattacgagaatccgtatcagagagcttttcccaataatcataaaatccttcatacctaagcaagctattttcaataacaacaaaatatgattgtaagtgcttaggaattttaccataagggttataaccagtaaagtctagctgctcctcacccatggaaattccccaaaagtctagctgatcggaattaaactcagagaaaacctcttccaaatctctaaaaggaccaatattcgtatcattaaccaagatgagctgattatattgttgtaacgcctcttttccagtatgtattatcccgtgtcggaaagccgcaacgtcatagccctcattatctctttccaaaaccttaccaaattgtgctaaacgatttatatcagcctgtggaagtttaccatttacaacaattaaaacatctcgagaaattttagccaatgcctctaaaaaaattactttatagtcctgtaaagacgattgatgttcataaattgtgtaaatcaagtaacgatttttgatatctgaataattatttctacgttgcttatcacgttgcaaagctagtagagttcgctttatatattttggaattctccagaaaaactttgcaatatttttggtaagctctaatatataaaacaatagcttgtatttacctgataagataaataatcgcgttgtgaaatttctaatccaccttttcacagtgttaccaatcactttctattattatctacttttataaattttcaaaagtttgttttgaataaatgttgatacatatatccccagaactctggtcattaaacctgagattctaaacgaaacaagttctaccttctgtgaatattttagcaaatatctaaattttttcacaaacatttttatatcaaaattattcagatatggaaatacaaatggcaagatggaaatataagaatttgataaataaatcaaaagtgcttcttgtttctcattcgatagttgtttaaaattctttaaattttcttcaattcctctaaaggcatgttctacatgtcgaagcgtgacattatttgtaatacttccttgtcggttctgacgatacatgcattgtgtattatctacaacaataaatacattcaactctttcaagagatttgcacaccaaataccatcttcatataaatatccactcaagaaattaagagcagaggtaaatttatctcttctgacacacttattccaagcaggggtgattagggctcctgtttcaacgagtaagcgcgtatctgtaataacctgatgaaacggtaattttttagaaaaatttcgaactgctacatcatccttaccgtaaaagtaggaaaatggatagataactgcatcaataacttcatcatgtgaaattatttctctattaacttcatctaaaaagcatatatcggtccaaaagtcatctccatccagaaataaaatatagtcaccactagcattctttatccctgtatttctggctgcagataatcccccattagtttgatgaaataccttcaccctatcatctttagctgctaatttatcgcatatattggaggttttaccatctgtagaaccgtcatctaccaacaatatttcaaactcttcataagtctgattcagtacactatacacacattcttccagataatcagcaacattgtacgctgggataataacggaaaacttcacacctagactcctttttgtaatctaattttcctatatttcatgaatacaggaattaagactgtaataattttataacgcaacattggaaaaggcttcataaccatgttaaaaagattaaaacagaaaaagtaaaactgccaaccactctcaaattgagtacctctccatggcgtctgatttaatgcagaaacatagtcctctctaaatcgatgtttatttccgattctccatggacgttcttcacctaaaaaatgaacaatacgtggttgcttacgaatttttacaaattcttcttttgaaataaacgttgaaggcctacttaatttttccaacgtacgatatggataaacatcaaaaatattaaaataattataagtgattgagagtgtttttatctcttctttcaatgctccattcagtgcatcttgatcattagcaaaaagctctccatttttttctttataataatcaaaaataattgttcctatactttttgaacgccaccgtttcaaatcgattagaagaactcccgcattatgatatgtatacgtacccaaatttaagccttctcttctctcagatgaagctgtcggttctgggcacattccaaggactttcccctccaaatctacttcccatagctcccgaatattttctaaaactaaagtatctccatctaaatagatgattctatcaacttcttcgggcagtaatttatctacaagtaatcttgcaagtacaaccgaagcccaaccatttgtgtcaacttcaaaatcaaaatatgattccaagttttccaattcaacgattgtcaatttatttcctccgtcggtaacaaattgatgaaggttttctttattctgttgacttataccatctgagaaaagataaaaatggcatgtatcgtcttcgtctaatgttcgcatgattgagcccatacaagctgcaacttgcggaacaaaagcatcattcaatgtaaataatatattcacgtttccctcttccactatcttcttacacccaataataatccactatcaaaaatagatacatgataaagttaatgactactgtgccagtgagcaaccgtatcaaatacttctgttttaccgatacacttacctgctcttttaacattaaacatgccggaaatagatagactaaaaacggagtaaagtatcttccttgtgccccttgagaaatcattgcatttggtccaatagctgtcggtgtccaggcaaaatacatgcccgctacaatgatagctacctgaacagggagtacaaataacgacgcaagaccttctgttttacttatctttaaatttccatcattaaataataataacgtaaaaatgaaaatatctatgaaaattaaccagagaggtagttgagtgacaaaccagccaaaataaccaaaaataccaaccgttaaaataccattaagatgatcatttctattattgataaataaactgtttatcatcactttcacaaagtgcacgacaccacctctattatgtaggaatagatagctaacaagtaaaactagtccaaaccctaaaataagaattggtaatcttctcttttgaatccattttaaaatcgaattaaacttagataagacgccttcaaattcaaaatcaacaaaaaacaatagtgccaaaagtaaaatattatttgcttttgttagatatagtagcaaggatagtaatattaagttaataaatttcctggtggtcagtaccttgtctaccaataagttaacataaaaaacaaaaaatgcaacaacagccagatagttcaccacatcataagacagtgagccagcctgctgaatcatcataggtaaaagtgagacaaaaaacagggtcatcttcccatactttattttttttatcaaatagtagatacctataatatagactattgtattaaaaaggcgccctatagtgaccatcataccatatgacggataaagcaatttacctacaactagaccaattagctgaggtgtactcattaacgatttcagagaaaaatcgatagataatttgtcctttgaaaaatcacgaattttggtaaaaaggcttgaatattctgtagaatcaactgcatgaatctccggttctgaatacgtaaaatctgctgcccgtaattcattcattgcctcagtatctctacttgtcggagaatcaaataatatattccacgacataaaagcatgtgttgcttcatcaggaacctttgtcacaggcataacaaatattgaaattaacaaaaaggggattgctaaccttaaaaataatttttctatcttcattcttgtacttcccaattcaaatgtttttgcaattttagatatattactaaagaaattaaaaaccaagtccacatcgaactaacaaaagcaatagctgcccccaatattccataatattctaccaatggattagaaatcaatatggataataaacaagaaattgcaaatgaaattacgagatacttttgcttcctcaaaacagtaagcatgttatcacaaatggttgcaaaggtactcgcaattcccccaagcattgttataataaagctgagccagtatttattaagattcgttccgtagagaatatttaatgctggaatccccaatactattcccccaaccaaaactaacacagccaatccgacaaccattttaacgatacgcttctgatattgtttaaattgattatagtccccagctcttctatatatagccaactgagttatcatgggtctaaacaaaatcaacaaaatattcattgaaaaaacaggcataaataaaatattaaaatctctttgaacacctgttcctataacacctctctcaaaaaaagtattgagagcatatttaggttgattatagatagtaacaagtaaaaatgcattaataaataacggcaaacattctaataatatatttttaatggctttcaaattaatttcttctttgataatcctcgtaaattgaaacaaattcgtaacatcaaaaaagaaaacaaataaatatgagctaattactagatagattaatgagagtagcaggttattggttataaacaaaccaaatccaaatgtcaaaatcacaatagagtttctcaaaaaaagtgatttacctgcaatatctagccgagcattttgttggaacaatccttgaaaaacatccgatagagcatcacttccacgatacaaacatattaggaaaatacaagcagatttttgaaattcatattgagacagaaaaatatagcttaaggcaagtaatagcataatagtgattgttataagccttgttgcaagatactggctaaacgaaaattttttcgaaacatcagtagcttgataatctcttacctgaaaactagcaatgattacaaaaagatttgctactgcataggcaaaactaaaaatatcagcctctaattccgtcaacaaacgtgttactagtaacaataaaaatattgatattgctgctgaggaaacacttcctaataaattccaaataaatattatttttggtgatactattctgctcttcacactttcttccccttgtttgtcatccgttatccctaattttttaatagagatttctttatcatcttaaacacgcttacaattccaactgatattatctttagtgtccttctcagtccaatttgtaaaaattccttctcttcaataattaaacgcaattctctttcactagaaaaactaatcttttccaatattggactcacattttcagtattctcgaccactgcataatcgtttgataaatcccacgcgctataaataaataatattggaactagcaataatctatcttcttttgaaaaatcaatgtttctaaatttctcctcaatctttttatagtgttctgtttttatccaataccaacttacttcttctccaattatataaggcactttataaaaatcaactttcttagttctcacaagtgattcataaagtatattcaattgacgaataagttctggattgccctctcgaagactttgtctatcatatctttgattagttgttaagtctggaataactacagccaaattagattgtgattcaaaattagaaatcactgcatcaaatgatgtaaaaaacattttcctcaactgatgcctgtcaataatatcctctacagaatattttatttcctttgtttgtttgacagttacatgagcaagatatttggcatctcccatatagttgtttactatttcaaaaaaatgcaattcatctgtgagttttgcaatctgtgctctcaattggtaggtgaataaacatctctcaactatactacacttatttgaaaaatcagcttctggcaatgttattagtaactggcacctatcggctattttgcataactcttcaatatactcttcaaaaatagacactgattctatgtgaacatgaagaagtaccgacgtcgaagaacgaacggtctctgtcgtttgcgaaacccgtatttgaggaataaaactcgtacccggaatgattatctgcctcaaatgcctctcgattaattcaactggatatttcgttttcatcctaataagatgtaataaagagtatattctgtctggatattcggtaaaactctttatttttatgaatggaacattatttttaagtataacttctggatattctagtgtaatgttgctattttcaagggttttacaacaaatggacgtatctaatgcacacttatagctatagccctctgataaaagtatttttgtcaattggctctcatataattttataacatcttgaatatctgttaactcacttaccgatgaccaaaaaccaacaaatgcttgactctgcaagattcgttttttaaataccataaaatatgactgtaaatgttccgggacaactacactatctatttttgtctctaagtgattggtcatcccccaaaaatctacatcaacatcactgtcaaattgactataataatcctctaggtcccagagggggccgaaacatgtatcattcatcagagttaccgaatcatattgataaaatgttacttgattcagcccttctttccatgccgcaaaatcataaccaatattatctctttggataaaaaaatcaatcagtcgttccgactgtaaatattgtactatgtcctttgaaacatggctgttagaaacaaaaactatgtctgaataaatacttcgtatcgactttaattgaaaataaatatattcactaacaacattatatttattatagtgaacatataccaacaaacgcgacattctgcctccgttatattttattaatctagcagctcccattggctatttctctgaataaacccggttgctgcgtcttcctctgcaatattatcagtactaaacttcctactaataaaaatagccggtgtgtcagatgtcttggcaaataataacggctgcttattactatttcgtactgacaccgccatttttaattttgcctgattaattgaaggtagcttacatttcactcggaaaaacttctcgcctttaccaaatgtttttaaatccatagaattgtcgttatatacatcaaaatgacgttctaaatctaaaaatgtaaatgcaacatgtgtttcaatatcttctaaaaccgtatatctaaactcgatttcaattgattcatctggttcaatttgattttttgagaccaggttaatctgcaaatcttttacaatatcactctgatgcagaggttcttcgttttctgtaacttcgcttattgaggcaagcacattatcaaaactgtattgattagctacatcatcaggttctcctaatgccttgacgtatcctttctctataagaagagctttattacaatactttttcacagctcccatatcatgggtgacaagaatggttgtttttccactttttttacgctctaggaagtaatcattacatttacgctgaaaggcctcatcaccgactgctagaacctcatcaagtatcagaatatctccttgagctttaatggcaactgaaaaggctaaacgtacctgcataccactagaatagtttttcaacttttgattcatgaattcactcaattccgcaaattcaacaatatcatcatacattgcatcaatttcttctgcagtaaatcctaacatcgcaccgtttaggtatacattttccttaccagttagttccggattaaacccaacaccaagttcaataaaagaaactaatttaccatccacagctacagtccctctttcaggaacatatatttgagataaaatttttaacagtgtcgacttaccagaaccattgcgaccaacaattccaaaaaagtcccctttttcaacttcaaaactgatatcctgcaaaacattatactctacgtagcctttaatccctttaaataaattaactaaagtagttcttagactctgactactctccgttggaagcttaaaactcttgctaacatgttctacttttacagcaatattattattttttaccattacaaaatctccgcaaactttttggcattttttctaaacacagttatacccaataggtaaacaacgactggaagaatatacggaattgccacaataacaggattttctatcaattcactaactgtagtattcccagaataaacaataaaatgtctcaagtcttgaataatttgtgcaacagggttcaacatcatcaacttagcaaatgttacttgcccacgctgtaaaataaatgtcaatgaataaataattggtgtcgcatacaatccagcctgtaagaacacttcccaaattggaccaatatctctaaatcttacaaataaggaagatagaatgaaagctatacctgttgctagtaacgccaattcaaaaaacaatgggattataactaaaacggaccaagtaaagggaaccccgttaatagcagcaaatacaaacacaaccattaagttaatggcgtaattaattgcagctcctgcaactgaagaaaagacaataatttctttcgaaaaattcaatttacgcaacaaatctccgcgtgaaacaatagacatcatccccatattagttgcttctgtaaaaaagttccatgttaccatacccaatagtagccctactgcataatgaggagttccatcatcaaagcgcaaaaaacgaacaaatactaaatacataattgtaaaaagtaacatcggtttcaaaatcgaccagagatgcccaatgagagaaccttggtaacgtaatttaaaatctgttttaatcatctctcttaagagtatttgattttctttatttaataaattcataactattccttatatgcaaattttgtcacaatcagtgttgtgaatactaatgtatggaaggttttgttttttcttaaaccatattttctcaaaatcctgaatcgttcaagcattggtttatccataatggttacaaaggcttctattaattctctatttgattgagaaaggggcatttgtaataaatgccgggcttgtttttgactatttttaatcaagtcccaataaactgcaaataaaatatgagggcgaatccattttttaaagcgttttgagagtgttcgagcccctaaaacattatcagaatgctggcgatagagttcgccaggcttgtcaataaaaaccagtttacccaaagccgaggccaacaaagctaaataccagtcatgcatcaaaatatcctcagttacttgccacatttcagcaagatgatgattaatcatggcgacaccgccagttacagtattctcagtcaactcttgcaccaattccgtattggcatgatgagattgagattttaccatgctttctgccataacttctagattttgattgacaactttgaggtccatataaaccatcaatggcaaatttgttggataggcttgtgcttttttcaggctaacttccagtttatttggtagccaaacatcatcttggtcactgaaaaaatagaaatcagcagtatcataatgaactagcctatgaaaacttttgatgacaccgagattttcgtctgtctcaacatctatgaagtgaattcgctgatcttgttcaacaaaatctttaataatctctctagttcgatcactggaaccatcatcacgaatgaatagtgtccagtctatgtatgactgttcttggatagagcgaatttgctcagctaagaactgttgaccattgtaggtcgacatgagtatatttactttcattgtaaaaataattcctcgtactcttggacgattttttcccaggtgtattcatccttcatgtgttttttcgcaatttctcctaattccatcgcttcagcattctcatcaatttggttaattaattgactcaggctacctgactccttactccaataccgagcaccttctagggcaactttgcggttaaaatcaacacctaaaaccaaattttcattggtttgcgccagcgcttctaggagactaggattggttcctccaacttcatgcccatgaatataagctcgacattcttggcgcagatacttaagtagttcttggtcatatactgttcctacgaacttaatccgcttatcggatataaagcctgtctcatctttcaatttttgaaaataggcagagccttcatggtttgcaacgatgactaaatcacgtctcgtgttacttgccataaactccctaattgctgtcacatagttattctcaggtacaaaacgaccaataatcagataaaattctttctctttaatgttccaatttgtaaaatattggcgaacttgctcagattcttttgttaacttagtcggacttaaatctgtaccataggcaataaagcgtgtattggtagccgagtattcagattgaatataatcctcaattccctcattatcagcaataatcaaatcagcatatttgaccatcattttttcagaaaattttagatacctttggactggcttagcccacttggcccgtttccattccaaaccatctggattgacaaacaaggtacctccaacagagtgaatctgtttcgcaaaaggtactatgaagccacctatggtatttcccaagatatagaaaattggtcgctctatctgctgttccttaatgattttaagggcataagtgatcgccatcatatcataagcaatcacacgagccggtccaagttttggtggattaattgtgaagcaatctgcacccaggtaggtcgaatgttggtgatgacttgtatccgataaacaagccacatgataacaaatcttctcagattgctggtgactgaccaattgttggacaaaggtctcaaagccaccatattttgctggcagtccacgactaccgataataaaaacgtgtttcatgaatcctctccatcaaattgcagttcttttcattataccattttttagttttttttcctaattctatcctagtttggttataaaggcttttctttttctacgcctctgactccacagtatagataaaaacaaattttgagttaataagaaaaatttgatataatatgtactggcttttacataaaaatataaaacttagaattgttaataaatatgaaattaatcaaacagcttattcacatactaatctccatcggattgattggaagtttttttctctatgcacacctcattcaaaacgaattaggttctacaaaaaatgatggaactatagaaataatcgcagaacaaccaaaccaagtaatcgacagcatccaaataaatggacgttatattcattcatcagaaattatagaaaaccaatggggaatcaatgacgctgatttaattcccaatttttcttctctaggtgaggaaaattcactcgtaattaaatcttcctcttctgtaagaaccttatcatttgaatactttgttagtgaaaatccgactattgtaaaaattaaagtcggtggacaattggttgaatccattgacacatcaactggagataaatataaaaatttagcctttattgagcttccctatactttacggataactaaagataatcaattttggtacctccacttaatagtccttgctttaggtctaacatgctttatcttaaatggagcaacatggagaatcaaaagaagagatatccgtatcttaacaatattattaatcgttcaatatatattcactacttttacatttccacgtttatatcgcaatgaattagtgctatttaattcgaactttaataaaatggaaactcaacagctattagttgcactgacttaccttatattttttagtcttttgggatacaaacaactccgaggtcatatctctaaagccttcaaaacgattagtctatcagtaatttatcttctagttcccattttttcattatttattattgaaaatagctactcacaattctctactctttcctccaatagtctttggaacaatctaatcattatcggagtcctctacctaatactggtctttacaactaacttacgatttgccagcctattaattctatccgcttcagtatttattggtataagtaaccaacttttgattgacagccgtggtgctcctctattattttataatctttttcaaatcacagacggattaaatgtagcttctagcgtagcaattaatatcaacaatcgaatgctacaaagtatggtattttcttatatcttattgaccttctttttctttatccccaaattatatttaccaaaacttctaccttctagaacgttttattctagttatgatttcaaatggccgaaacgtttcagcagaattttactgggctatataactttaataacaatcgttccaatgattaataaaactgtcgtctctaatgcaaatatatcattaaactactggagaatgtacgtcacctatggtcaatttgggctaccactctcactcgcctctttctatgaagatagtaaaataactaagcctgaaggatactcagtccccaaacttaatgaagttcttgagaagtaccctcctgaaacagaaaaacaaacaatcagacctaatattatctttatacagaatgaatcacagagtgatttttcaaacttacagggcttaaatatggagcctaatccgctatcaaaccaacatgctttaacagacaatactattcatggcaccctcaatgtctcagtctttggcggtggtactgcaaataccgaatatgaagtgctgacaagtaacccaatcagtttattatcttctaatttattcccatatcagcagattatcacacaagaccgtccaagtttcgcaacttatctaaaaaataaaaattacgacactgtagctctacatcctcaatccggaaataattacaaccgcaatgcagtgtatcctctactggggtttaataaatcttattttttagattcggaacctgctattagtagcttagcaccactaacaatcgatcgtggctggccatctgatcaattcttgttcaacggaataaaagaactttatacccaaaaaggagaccagcctctatttagctttgttgttaccatgcaaggacatggaggctatccaagtacggaagaaatttatcctcgcgaagtcagcattaatggttcaacatctgaatacttagctgaaacagaatttttgaccagcatgaaaagaacagatgaagcatttgcagatttaattactttctttagtacttacaaagagccaacagtcatcgtcatgtacggcgatcaccaacctagtttgactcaggaattttacgcacaatttatggatgaaaataatcctgccgctaaatattctacccctttagtgatttggtcgaattttgatattagggagcgcgaatctacaacaatcagcccaaactatctcgttccatatttgatggatattttatccgaatccgactatgcccttcctcgatcaccttaccaacaatttttgagtgatatgcaaatcgaagcacctatcattactagctggggaaatatcgataataatggccaacaaattgaagacctatcaaccctaccactttaccaaacctacttacaactagaatacaatagtgccattgacaaacaacctttaacagatttatatgagtgataaaaatagccttgctcggttttgagcaaggctattttatcatcaatcacccaaaaaacttaattatctaaaagataaagcttgtaattctcgataattgatcgtaatttttcaccatatttcggatcagtagcatatcctgattgtcttagcgcaagaatcgcttgttgataatcagttgcctctctgaaactctggtaattttttattctccacggagtagaggtaaagaacttagcatagtctgctacactttcattccatgaattatattttctaaacaagtgcttttcttgcttcttctcaccatcacggtattcattggtaatgatttcaattgtagcacctgtccacgcagcatccgctttgatgccaaaaagattattcccatgagtcgccaagtatgacgttccccatgcactttcgaggatggcttgagataacatgacgctcgaaaggatagaattagcttttgaactttgttcaattgcaggtactagattggctatgaaacttttttgatcattagaaagttttcctgtttcaatacctgtacctgcaatttctactttccctcaacagcaccataccaattcattacaccttgtgccaatgctttcgcaaggcgagtgtggtaagaatcttgtttgataacttgcaactccgaaggattatccataaatcctagctccactagaatggcaggaattgctgtctcgcgaaggactgcaaaagtttctcttcttacaccacggttaactgcacctgtttctttaattaaactctcctggaccttgttggctaaaatctcactttcagctaaacgagtagggttattatgcatttctttattaattttaggttggtattctggattatattgataccaatatgtttcgataccagtcgcattcgaaactcctgcacccgtcgcattaaaatggatactaataaataagtctgcgttgcttgcattcgtcattcgtgacctctctgttttgaagtctacatcataatcacctgtacgggtcatcaaaacattgattccatattgcaagagattttcacgcaacttatttgaaacagacaatgcaagatttttttcatgtacgccaccgtaagaagcacccgagtctcgccctccgtgccctgggtcaatatagactgtgtaggatcgctgtgccgacggatttgataaatgagtcgttgtaccacctgcacctgtcaaaccaccatttgaatccttataatataagtgaaccgtgtaggtacctgtacgatacttatggtccttcttattaacagttaacttataactgccatctgactgacgagtagcttcataccaacgtatatcgtctgactgggaccaggtaggtaagagaacacttgctatatctttcggtgatgaaacattagtaacacgaacatcaaaggtaccttgggcatcattacgattttcaattgtgattgtacctgttggcttcgcttctgataaatgagttgttgttccacctgcacctgtcaaaccaccatttgaatccttataatataaatgaactgtgtaggtacctgtacggtacttatggtccttcttattaacagttaacttataactgccatctgactgacgagtagcttcataccaacgtatatcgtctgactgggaccaggtaggtaagagaacacttgctatatctttcggtgatgaaacattagtaacacgaacatcaaaggtaccttgggcatcattacgattttcaattgtgatggtacctgttggcttcgcttctgataaatgagttgttgttccacctgcacctgtcaaaccaccatttgaatccttataatataagtgaaccgtgtaggtacctgtacgatacttatggtccttcttattaacagttaacttataactgccatctgactgacgagtagcttcataccaacgtatatcgtctgactgggaccaggtaggtaagagaacacttgctatatctttcggtgatgaaacattagtaacacgaacatcaaaggtaccttgggcatcattacgattttcaattgtgatggtacctgttggcttcgcttctgataaatgagttgttgttccacctgcacctgtcaaaccaccatttgaatccttataatataagtgaaccgtgtaggtacctgtacgatacttatggtccttcttattaacagttaacttataactgccatctgactgacgagtagcttcataccaacgtatatcgtctgactgggaccaggtaggtaagagaacacttgctatatctttcggtgatgaaacattagtaacacgaacatcaaaggtaccttgggcatcattacgattttcaattgtgattgtacctgttggcttcacttctgataaatgagttgttgttccaccagcacctgttaggccaccacttgaatccttataatataaatgaaccgtgtaggtacctgtacgatacttatggtccttcttattaacagttaacttataactgccatctgactgacgagtggcttcataccaacgtaaatcatccgtctgtgaccaagtgggtaaaataacacttgatatatctttcggtgatgaaacattagtaacacgaacatcgaaggtgccttgggcatcgttacgattttcaattgtgattgtacctgttggcttcgcttctgataaatgagttgttgttccacctgcacctgttaggccaccacttgaatccttataatataaatgaaccgtgtaggtacctgtacgatacttatggtccttcttattaacagttaacttataactgccatctgactgacgagtggcttcataccaacgtaaatcatccgtctgtgaccaagtgggtaaaataacacttgatatatctttcggtgatgaaacattagtaacacgaacatcgaaggtgccttgggcatcgttacgattttcaattgtgatggtacctgttggctgtgtaacattgaccgaactggaagctgtactgactcgagcacttggaacacttgtagagccattcgaacttcctgcaatcgtatttgaagaacttcttgtcagcgaattcgaagtactacttgttgcacctgctgtcaaactagaattaaccgttgagcttgtagtagtcgaagttgcttcctcctcaattttagacggagttgcatcactattatccaaagcagtaggcttctcagccgcgcttacgacatccttcttccactcgaaactataatctgataaggtctgaaaacttccatctgttaattgtgctgttaacttcagcgaaaagacttggtcttcctccgcaaatgcagaccgatccaaaaccgctacgtatctaccctgctcatccattgagaatgtgacagtaatgccgctatttgtttcagagctaaactgggctgtaacaccaataatttccccttgaatgttcgatagaatagctttaatctgaccagcctcatcaacgacagataactgcccgccagtttcagcaacctgagatgaagaaacttgactagatggggcatttaccatatccgcttgaacaagctgagcattcaacgcggatgcacacaaagaaagaaataataacgttctttttttcacaaacatctcctttatgtatttcacatgtaaaaacaactatatttctcaaaatagatgcaattacactaatcttctatttttcttcttgcttatttgtcaataaccaaccagcaaaaattgttatgagtcctagtacagttaatggaagactagatttccctgaagtttttggcaataccttagcattatcatttgggataacctttttctgacctgcttcggaaatattgcctttgcctgtagctacatcagaaatctgaccgcccccttgatctggaacggtctgcaaatcatttgagccatttgtagcgctttgacttgtttgtaccccggtattttcagtcttagctgtacttttatcctcgacttttgattgtagactagcagttagttctgcaatctgtcggtccatttctgaaaagtcatacggaaattttggttgcgaagcagttgcaagagcttgaccatatcctatagttgcagatgtaatagattctaaattagagtttccactttccaataatccagctaattcttgtccagttgcttctgcataagcaatataattatcaatcgctgccgactctttattcagtagttcaacgataacttctctagcgtatttcaatgcagccaattcggcttcaggagtacttgcatcatcttcagactcgtacttagaaactatagccgccgcttcttctcttccgctttttccagcgactgtaagtgtctcaaataagtaatggtaatgttgggctatgctaccaattaaatttgcttcgagttcatctaaaacaacaacttgctctgctgttaagtttgccttcaagtctgcaatttcttcatcccacgcagcttcagcactacccgaagccatttcttccatcattccctcaagaaacgccaatctatattcttgcatatcgatagtcattttagcttgaatatattcacgtacggcaactttttcatcatcagttaaatgataggtcgtactttgacttgtctctgctgctacaactggaacagctccggacggtaatgtagcacctcctagtaaagccagaaaaattcctgacatcaacaacggcttaacaatcgctttctttttcatacacatctcctgtagactatttcttttcttgtttatagaatgcttccaatgcttcttgccaagttgggatgacaaaacctgtcgcctttgccttgtccaagctcatggttgagttgaatggacgttttgccttggctgggaactggctagaatccactggcaataccttggtgttggtatccttgaggacttccgtcgcaaagtcaaaccaagtcgtatcttctgctgcatcgtttgacaaatggtagtaaccaaatgcttgcttggtgtccaccaagtgtaccatgaattccgcaagggtacgggtccaagttggacgaccgtgttggtcattgacaaccgtcaaagtatcgcgggtttccgcaagattttgcatagtgaaaacaaagtttttaccgtagttaccaaagacccaagctgtacgaacagtgtagaatttgtcagcaaatttctcaactgcttcctcacccttgcgcttggtgcgaccgtattcagattgaggatccggttggtcatctacttgccactctttgccgactggcaaatcaccattgaagacatagtccgttgagatgtaaacgagggtcgcacagtatttagcggttgccttggcaacattttcagagcctgttacgttaatcttgtagttgagttccttgccttcatcctctgccatatcaacagctgtgtaggctgcacagtggtatacaacgcttggctttacttctgcaaagaaggcatctactttatctgcatccgtgatgtccatttctgctacgtcagcggcaacgtaatcaacaccacgctcatccaagagataacgcaattctgtacccaactgaccatttgcacctgtaattaaaatcatatttgctccttatttcaagaaaggcttgggcaagagccctagcctttaataatcttatttaataacttcctgtgtcttagcatagttggcttcaacagcttctttttcagctttccaccagtcttggttatctgtataccactggatagtctcttccaaaccttgagagaagtctgtgaattgtggtgtccaaccaagctcgtcacgaagtttgcttgcgtcaatagcatagcgcaaatcgtgtcctgcacggtcagtcacgtggtcgtaagcatcttttggttgacccattttttcaagaatcaattcaagcacttctttgttgttcttctcaccgtcagcaccgattaggtaagtttcacccatacggccttttgtcaaaattgcccaaacacctgtcgagtggtcgttggtatgaatccagtcacggacgtttttaccttcaccgtaaagttttggcttaatacctgccaagatattggtgatttggcgtgggataaatttctcgatgtgttggtaaggaccgtagttgtttgaacagtttgagatagttgctttgacaccaaatgaacgcacccatgctttgacaatcaagtctgaagcagctttggttgatgagtaaggtgatgacgggttatagttggtttccgcagtaaatttctcgcctggaccttcgccatgacctggcaaatcttcacgcaaaggaaggtcaccgtatacttcgtcggtcgatacatggtggaaacggatgtcgtatttacgagccgcttcaagcaaagtgtaagtaccgataaagttggtatggataaatgggcttggatcgttgagagagttgtcgttgtggctttctgccgcatagtgaacgatggcatctgccttagcagccaatttgtcaaccaactcagcatctgcaatgtcgccaacaaccagctcaacacggtcaccaagaatagcttccaagttagccttgtttcctgcataagtaagtttatccaaaacagttacgtgaacgtctggatgattgttatatacatagtgtacaaagtttgaaccgatgaaaccagctccaccagtcacgataatatttttaaattgagacatttttttctccgaaaagtttttttcttttttgtgtgtcatcttaggtagtggggtcgtaagcaaccgccaaggtgtttcattactaaaccatgagcctaaggtctcatggtttcccccgctccttagcaaagcaaaggagcttctcactacggcgatgacacacagaactgctcgcttcgctcgcttttttacctcaagatttccttcaagtaagcaatcttagcaaagtctttttgattgttattttctgcacggtaggaatcttttgaagaggcttggtagattttcaggtattgttcaagtgtcggtaggtaatagcgaacacctactgtttctagttcttccaaatcttctagctctacaccagcaaattcaggcagtgaatgtaggcctccgaattcaacagataagccgtctttatgaaattcatgttcatgacgatcaaccaggacatagccaagttgattcatcagaacaatcagctcatctgcacggtaaatccgctcctcatctggcgcttcccatccccgtgggtcactgggcacatgaatatcaagatcccttgcctgccaatctcgtcctgtccgcctttccagaccaacagaacccattaacaagggagtgattcctaacttgtttaactgctctgctatttccaaaaaggcttgaaacattagaggtcctcttttctcaaaggcttgacgtccttgaggaatgggtggttttcatctgcttctgaaacttctgcttcttctaggttttcccacttgatgtcgaggctagggtcagcgtagttgacgaaagcatacttaggcttgagttccaaagcccagtagtcgttaaccaagtagctgtaagccacgaaatctgacaagacttggaaaccattggctactccgcgcggaacgaagatactttttgaagcatcgataacggtttggtaggtattaccgaaggtttcgccttcacgtagatcgacccaagttcccaaaaccttaccgccgtctgctactgaaatgtatttatcccaaggctctgcgtgaagaccacgaagaacgtttttacgagagaaggaaacattattctgcaattttccttctgcaaagaagctttcaggaaagccgagaggcaacattttttccttttggaagttctccttaaaccagccacggttgtcgccatgaacaggaatgtcaaattctaacattcctggaatagcttcaactgggcgagctgctagtgttttaccgaaaaagttttctgtcattaagcttctccaatcaaacggagcaagtattgtccgtattcatttttcttaagcggttgtgccaatttatacacttgttcttttgtaatgtagcccatgcggtaagcaatttcttccaaattagccacttgaacgttttgcaaacgttgaaccgtttcgatgtactgtgcagcttccaagaggctttcatgcgtacctgtatccaaccaagcaaatccacggcccataagctcaacagacaagtcgccgcgttctaagtaagccttgttgacatctgtgatttccaactcgccacgaggtgaaggcttgatatttttcgcaatctccacaacatcattgtcatagaaataaagaccagtaacagcaaaattcgattttggctcttcaggtttttcttcgatagagatggcattcatatcagcgtcaaactcaacaacaccaaaccgttctggatcttttacttgataaccaaagacagtcgctcccttttctttgctagcagcacgttgcaacatcttggtcaaaccatttccgtggtagatgttatcaccaagaatcaaggctacattgtcatcaccgataaattcttcaccgataataaaggcttgcgccaaaccatctggacttggttgttctgcatatgaaagtgaaattccaagttcagaaccatctcctaacatatccttaaaacgtggaagatcttgcggagttgaaataatcaaaatatctttgattccagccaacatcaatgttgacaatggataataaatcattggtttgtcatagataggcatcaattgttttgaagccgcacgtgtcagaggataaaggcgcgtacctgaaccacctgctagaataatacctttcatataagagtaccttccctaaattaatatcagttcattataccatatttttaaagatattgtcataagaaaaaagcctgtgacgacagactttaacaaattatcctagagcaacatctaaaatcatcatgatgataaaaccagccattaagcccagagttgcaatatccgtattgccgtttgtctgcgattctggaatgagctcttctacgacgacaaaaatcatggcccctgccgcaaaggagagggcataaggtaaaataggtgtcataaaagtgaccgcaaaagcaccgatgactgctgcaatcggctcgacaattgctgacattgatccccagtaaaaagctttccacctagatgcgccgtctgtacgaattggaatagccaaggctgccccttcaggaatattttgtataccaatcccaatagcaagaccaattgctccgataaaagctgctggactatagttagaagcaagtgcaccaaatatcacaccgaccgccaaaccttcaggaatattgtgaattgtaatagctaagaagagcagggctgttttggatagattttttctatccttctcaccaccaccttctgccttatctttatcatttcccaaatgcaaatgcggaacccaggcatctaccaagcgtaaaaaaataccacctgctgcaaaacctactgctgctggtatccaagccagattgccgtatgaactttcagcatactcaatcgatggggctaataaagaccaaaaagaagccgcaatcataacaccagctgcaaagcctaacatggtgtctagcaaacgacgactaactgtcttaaagaaaaatacaacggcagaccccacaatcgtacaaaaccatgtgaataaaccacctagcaaagcctgtagaactacagactgattagtaacccaagtcataactaacatcctatcctgtttaatcttgcatatcctataaagtaagataccctaatttattataaaattcaagctttttcacttaaataaataagaaaatatctaaaaaataaaagacctaaaactacattaaatgtcgtcttggtctttccacaatcaagtgctgattaatttatcacaaatgtctaaacggattggttgaaacagttgaaggtagaatttcgacatcccaaccttcttttgccttccatatttccaacaattcagcaatttttttgataaataatacttcgatatgatggcctggatcaatagccagcaagccctgagtcagcatgtcctgcccagtatggtagtaaatatcgcccgtgatgtaaacatctgcccccttagcaagagcctcatggtagtaagacccaccactgcctccacagatggctacacggctgacatactgcttggcttggtgcccataggtcactagacggacagcatctagatcaaagacagacttgactttcaaagccaattcttccaaagtctgctctgctattgtccccacacggccaagcccctgcccctcggcagtttcaatcaagtaggtagtatcttgaatttctagtagttcacagaaccagtcgttgagaccaccctcaaccacatcaatatctgtatgactaacatagactgcaatatcatgcttaatcaaatcaagatacattttagtttgcggattgtcagccaccaaatcatttattggacgaaaaatcggagcgtgcttgactataatcaaatctacctttttatcaatcgcctctgccactgttgtctcacgaatatccagagccaccatgacacgttgaatctctttattaagggtaccgatttgcagccctttgacatcgccttccatagccaaagaatggggacaaaaggcttgatagcgctcaataacctgactagctaacatggactacctcctgaatttgttggatcttttgggaaatggcaaagcggtcaccttggcgttcagatggaacttgttccaaagcaaaacttaatttttcaagttctcttctccactttttgacgaaaactggcgaggtctcctctagtagatagggaccaaaacgacgttcaacttctgacaatctcatctgtcctgattctgcaacgaggacttcatataacttgccattttcttccagaatcttttcagcaaccaatctaaaaccatttttttccaaccatcgacgcacatcatcttcacgattatttggctggagtatcaaacgttcaatggtcgcaagcttttcttttcctgcttctaagatttccgcaatcaagcgtccccccatacctgctatggtcacggcagtcatctggtcagacttctcaaacgcgcctaagccatttgccaaacggactagaattttctctgtttgtcccgcctgctctacattctggagcgctgactgatagggaccttgaacgacttcccccgcaatggcaaaatcaatacgcccctgctctaccaaaaaaagagggagataagcatggtcactccctacatcaactagacgtgccccttgtgggacaaaacttgcgactgtttccagccttttagataattttgtttccatatcaatctttccagagatccattgcatcaagaaagtcacttgaaacagtcacattcttaggagtctggatttctctttctgcatttttcgcttctacttgcacaactgtagtaattccctcacggcgccagtttcgtagaatagcttggatgtatttccaatttgttttgttgttaaaaacagcttctttcaaggctgcacgaaccaaatcaatcgaagttttgtcatcctcaatagtcttctgcaaatcttcaatttcaaacggcgataaaaagcggcccaattcacgttcaaaatcacccaccaaggtcttcaaatcattctctggttgcacaatctcaactgcctgttttggagttaacagaacatccaatttttcaaaagcaggaagcgcatcgaatatcatttcaatttcaccagcaatactgattgtcttaaattctaagagtccagcatcttggagattttcaatagcttgattgacctgagcaactgttttaccagtagcttgagcaatctcactaggcgctaatgattcgatagctgaagaattttgatataagaaaaactgccaaatcaaaaaatcatctgccgacggaaaaagctcttgatagtggaataatattgctgctggcaggaccaaatgtccctgacgaaattgctgtgaatagttcatacttcctctttaaagactagctgactgggctgattgttcaaagatatgccagtcgtatggagtttcttgatagacagcataattcacccagttggtaaagaattgtgctgctggtaaattccaagagagagatggtttgcttgtagggtcatctcctttgaaataattttccggtaaatggggattttttccagctatacaatcacgttggtattccttagctagtgtatccctatcatactctaaatgtccaaaactataaattcctcttaaatccttgctggctagaatggataggccaacttctggaccttgtgataaaatcgtcaacccactcagatgggcaatatctgcttctcttacttccgtataacgggaatgtggtgaacgaaattcatcgtcaaatccacgcataagagggctcgttggattagtcacttcttgacaatatacccctgatagttttcgagacatactgtgtttgggtacaccatagcgtgcatacaaacctgcctgtgcaccccaacaaatgtgcaatgttgaataaacatgtgtttttgaccaatcaaaaacttgagtaagttcatgccagtaatcaacttcctcaaaaggtaaattttcaactggtgctcctgtcacgatgagcccatcaaaatagctatccctgacctgctcaaaagtcttataaaactgcttcaaatggcccgagtgtgtatttttggactcgtgactagccatgtagagaaattcaacctctagctgtaaaggagtgttagccaaaagacggagcaactgagtctccgtcactatcttctgtggcatgagattgagaataaggattttgataggacgaatgtcctgatgactggctcggtcactatccatcacaaaaatattctcttttctcaaaatttcaactgctggtaatgatttttcaattttaattggcataagcaacctcccaattttcttatatttattataagacaggttgctatgcaattcaattagaataaaaataggaccagttataagttttggctataaccttagattaatagtgcatcaaaaccttgtagtcgtaatcaccgattgcttcgcggcctttcaaatcatctagctcaatcaagaaggcacagccagcaacgataccgccaagcttttcaatcatttcgatcgttgcttttacagtaccaccagtcgccaacaagtcatcgacaatcaagacacgttgtcctggtttgattgcgtctgcatgcatcgtcaatgtatctacaccatattctttttcataatcagctgagataacctcacgtggtaacttacctggcttacgaactggtgcaaaaccgattcccaattcaaaggcaactggacatccaacgatgaaaccacgcgcctccggcccaacaatcatatcgatttgcttatctgtcgcatactgaacgatttcacgtactgcatagctataagcatttccatctgccatcaaagggctaatgtcacggaattcgataccttcttttggatagttaggaattgttgcgatgtaatcttttaagttcatttgtctctctctttttaaaaataatttttactcttcattataccatgaaattgttttttggtacatttcagacatatatctttagcaaatcgtctcctcaaattcgccacacaagctgctctactatgtccaccataggaaaagcttccttgctgattaaagtaagactgctcccagccaacctcatttcttcctttttggtagcgacgaaagcgagtaggagataaatagactcccatctttgagcgtagcaattctttccgaaaaatgggatcctgcctgccaactggagaggcagggcaaaaagctcagcgccacttcttagagttcgtgtcaacatctcagtgcagtggttgattggcggatttgttcgtgttttacactccaaatccaacctaatcaactgtgcgggggtgggaagacgaactctttttagaccagtcgagttctttcccactcccgcttattattagctctggcataattaaaggaagccccatttaccacgccattgacatgcggtcgttcttctaaaatcaaggcaaattgtccatcttgatttaggataaattcgctgtgaaaatgaatcaaaatcttcatattgactggcaaggtcttctgatttttcttgccgaacagttgtttattgtgtaggcgggcagattctcgtaagcgataagaccaccgaggtaggctacgtacataggctatcagagcctgccaatctgtttttccttttccaaactgctgacgcacccaaaaagtctgctgataggaaataaggtagcgtagctgatggacctgtctgtttaacggccgtttgacttctaattcccgaactggaaaagccttatcaactagcttagcaaagtaccgccaaaacggatggtgtggaggacaattcacatccatcttctgcaaaagttcaggtaatatcccatgacttaattcctcaggaaaatctaacatattcatacattgctccaataaggccgtcgctttctcttggcttaaagagcgactgtcaactcttatcaactgataaaagctagttgaggcaaaaatagtagcttcttttatgaaattttgaacaaatgctgggatgtcttcttgttttagaggcaacagttgtttcagaaaaacctttttgatggctctttctgaccatcctactcgccgtaattcaatcagtgcgtgctttatttcggttatctgttcaagatttttcaacaaacctttttgcctgataaaccaataagtgtagagaagcgttccaatcactccaacaaccagagcttctactgtcatcaaacgcgaccacatagccattcataaatttcctgaacggtgccaagcgccatcaactcttgttggataactgtttctttcaattcttgatatatttgactttctgaaatctctcgcttctgtgcctctttgttgacccgcatgaccccatccgcaatcgtgacaaattctaattcttggaaaatctgaatcattttaaccaatagactgtccttaatttttaagtaaacagccaaatctttcagtttatagcgaacatcaaactcttcaaattggtaaatagtcttatacaatttagcgaattgttctcggctaccataaccatctagatagtacggtttggcaatttcgtttttaaaataaatggcttcaaattctctttcctgaaaatagctacgcagactactgaggtcctcaggcaagttagccaagacaattgctttgttatctgctactggattttcaatgtccaaaattgggacccctgcaggaataggatgttgttttccacgaatattataaagttgaacaccattgacccgagcatcaaccaacatgagctgaagactggtattgccattccattgattgacagacaaggtgacagctagttctaagcccttggcctgtgaaaattccaaggctagattgcccttaccaaaagcaagaacatcaaatccagcagcacctttagtaatgcgtagtttcaaatgggcattattctgccccatggttcttgctgattccacctgaaagtctctgatgtaaaatacaggctttttattatccatgccgtaaggcgcaagcttctcgaaagattttagagtatctagggttaattcctctaaatccaattcttcatctaagaccagcgaagacttgctggataaatccaatttattttcgataatgtagtctgtcaaggtcagagcaagctcttcaagtttgtcaacttccaaggtcatacctgctgcaccagcatgaccaccaaaggcgataaataggtcctgatgatctttaagtgccttgaaaatgtcaactgcttcaacagaacgagccgaaccctttgccttaccatcttcaatagacaagacgataacaggttgctgcagttcttctagtaggcgtcctgctacaatccctaaaacacctgggttccaaccttctttagccagaacttgaacaggtctatcatgacggagcatggtttttgcttcatcgtaaattgcttggacgacgtctttacgttctacatttttactgtcaatcatgagggcaatttgatgggcctcttcgtcatcaaaaccagtcagtaattcgatggctggatttggatcatcgagtcgaccaagggcattcaacctcggagcaagttggaaaccaactgtttcttcatcaatactgtctatgtcaataccagctatctttatcaactcttgcaaacctgctcgctcagtctgtttgagaagcgagagaccatatttgaccatgacacgattctcatcggtcaagctaaccatatcagcgatggtgccaattgcgaccaaatccagcaagtctgcatgaacagtttcaagaagagcacaggccaatttaaaagccacgccgcagcccgccaaatgtttgaagggataatttccttctggatgctctggatgtacaatcgcataggcattgggaagggtttcttgcatggaatggtggtctgtcacgacaacatcgacacccatttcctgggcataggcaatcgcttcatgacccgctacgccattgtccaccgtcacaataagagaaatcccctgttgctcgataaaatacttgtaaactgactgattcggcccatagccatctgtaaaacggttgggaagataaacttggacttctgcccccatttcctccagagtttctttcagaatagatgccgaggtcataccgtctgcgtcataatctccataaatcaaaatgtgttcgtaattttcgattgctcggcgaatccgctctaccgccttgtccatatcatgtagtaaatagggatcgtgaaggtcttctaagcttggttgtaagaaagtatgcaattcttccgccgaatggatgccacgttcatacagcaacttagccgctaccgggtccactccttcttttttagcaattttgataaattgttcatcagaaaaaccggtcaataattgccagtcataattgggctttatcacgttttttactccttaatactcaaaatcacaagtagcctgtaaattttccgagtataaactatctttctattatatcattttccaagaaaaatggagcaaggtaagaccgaaacagaatgtcgatcccttgctccatgaagaacgaatattacaatttataataacggcgaaataattcgcagtagggctcctcccaaacgcttataccaagagtacgttttatggaaggttagaaggttaatttgctgtgattttttgaaggaatgagtaaagtcatccttaatagctgccaaaacttccgagtgattgtaaatatagagaccgcattcaaaattaagataaaaagagcgaaaatccatattcaccgtaccaacagtagctttcttatcatcgaccaaaacaactttggaatggacaaatccaggctggaattcaaagatttcaattcctgcttccaagtaagtcggaaaatcagtacgagcagccaaataggcagattttttatcgtagatatgcggtagcagaatgcgaacctcgactccacgcttcgcagcataagtcaaattatcaatcatttcatcatccaacactaggtagggtgtcatgatataaatataatccgttgccgactgaatcatgtctaggcagactcgtttggctacctcatctccatcaaatggattctcgccatacggaaggaagaaaccttcggcatcaacggtttccgtctctaaatctttatgcgttttgaggtattttaggtcatctgtctctgtcttttcattgtaattccacatttgaaggaacatcaacgtaaagtttgcaacagcttctcccctaatcataatcgctgcgtctttccagtaaccaaaacgcactttcttgttgatgtattcatctgcgatattaatgccgccggtaaaggcaacctttccatcaataatcgcaatttttctatggtcacggttattttgcaccgtagataaggctgggataatttgagaaaatactttggcttttattccatattttctcaaggttttatagtaattatagggaagattggtcagtgaattcatcccatcatacataaaacgaacttccaccccttgcgctgccttttccttcaaaatgtcaaggatagaatcccacatatatcccatatcaacaataaagtactccatgaaaatatactgctctgcctttttcaattcttctagtagagcttcaaatttttcctgacctgttgaaaaatagacggcatccgtattggtatgaattgggtagccaacgtactcactcatgaagtgagctaatttcagttgctccttatcttcctgctccaacgccttcatgaccttttcagacgtcttactatactcccgaagtctttgtgcttgcttatgaaaatttttacgataacgtttggtttcaatgttggactgcaaaataaaatagaatagggcaccaaaaatcggaataccaatgacaaaaataatccaggttaacttaaaactggtattcatcggtctattgatgattgaaatagctacaaaaatcgaaaaaatttgcaaaacaatcaataaagcaggcatataggttgctgccgaacctaccaaccaaagaataaggaaaatggttagaataatcaaactaatgacaataaatgtccgactatatataattttccaaagtttttccatacatctctcccttagttttttaccattataacagattttagttcattatcctactcaaaataaatagtctctatgattcgatatttctgaatattttaaatatataaacatattcaatttatattgtaaagacatatattttttgataagataggcatgaaataacccgttttaatttattaccccgtacacattatcaaaaggaggaagttcgcatgaaactttcatataagaaaaggctgttgaatcaagtcctacttgcctcaacagttcttttagctgcatctctcgctcagggaacggtcttcgcaaatacagaggagataccacctactactagtgaaacagtgactccactgcctgaagagactcctattacgaaaactagcacaagcgaagctacagataatcttgtagaagggaaggagacagaaaaacaaactgaagaaatagcagatacttctcccacacctgtttccacagaagaagatacaacatcttccgagcccaatgccgaggaaactacgctcagaacagctaataatgataatcaggatactacagaagaaaaatctgccgtaccgactattgatacagttacactcgaaacaaaaactgtctatctatcggaagcagtcactatcacagaatccatcacacttccagatacgactgaaaaaatagaatggacattggatggaaagtctatttccgaatggaaaacctggaatttgaaagagggagatttcacaggagatacttttatcacagtagaagaaagcagacaggataaccaacttcatttgaatatccagctcgcagctctctttggagaagatttgagtaaacggacaccgagtaatattcgccgtacctatcgacattttataaaaaatatgctgttggaaggtactagtgccgatggaaacttgataatttcaaaaactcttcatttccgtccttatgaagcctaccgtacacatgaggaaatgttgacagagattgaggaaacgaaaaataatgctgcgaccgaccgcctagtaaggattgagtcaattggtcaatcagctgaaggtagagacattaaaatggctgttgtggctaaagatcaagcaagtattgataaatatcttactgagacaacaccactcatgctgacccaacccgaccagatgctgaaacagttgcaagctggaaccttcgactataaattacctattctcatcaacaacactcatgctgacgaacaacccggcatagatgtggtaactagcctattcaaagaatttgcacaaaaagataccatcacctttccatctacagatgccgatggaaatcctgttactcttcatttaaaagtgacagatttgttagataaatttatcttcttgttcaatttcacagaaaatcctgatggcgatgttaaaaacttgcgttcactagtaaatggtttggaccctaaccgtgatactggtttccaagtgaatccagaaacacaagccatcgttcgtcaaatccacaaatggaatccaatatctgttttagatattcatggttttgtatctggatttctcatcgagcctgccactccgccacatgacccgaactttgaatatgatttactagccgatattatgctggaaaaagctcatgaaatgggccgagcaggtattgcaaattctaaatatgaacgctacaccatccctaaagtccactggggagatggttgggacgattccttctcaggctatacagcggtgtatgcaatgtaccacggtattcttggacacacgattgaaattccagaaggaaatcaagaatcattcaaggcgggattctttgctgttttgggcggtgttcacaatatggcaaccaaaccagacagtcttatggaaatgcgcctcaaatactattcacgcggtgtcaataaggtagaagatccaaaagcagagtctgaactagtcggaccagacggagctgttgtcggacgtgtcaaaaaagaccagccaaaattcttcccagactactatgtgattcctatgacgctcgataaacacaacgatatgcaagaagcatttaagatgattgaatatttcaatcgtaatggggttgttgtcaaggaattaactgaagatgttggaaacttccgcaagggcgacctagttgtcgatatggctcaagccaaacgaggattcgctaaccatgtcctctacgctggttctgatgaatctgcttggggagccatgtatgctgaattggtggtcaacttcccagatatgaaaggctttagcgccaaggctgtatttgaagaaaacacctttagcggcaaattaggtagcatcacatggacaaaagctccacgtactacggaaattgatttcaaagcgccttattatgtcgttgcaaacacctctgaaagcgccgttcaggccattaatcaagccatcaaatcaggcgctaaggtctaccttacagacgatggctacatcatggaaactaaccaatttagtcacttactggacacctatgctctatacggcgagcctctctataagaagcctcttggacaagaattgaaagcaatgaaggtgtacgctccttctcactcttatagttgggcaggcgactttgccattcttgcaaatgctgcacttgcggtagaacgaatgggctttgaaattgtcaatagcgcagatgaggctgatgctatcattctcgaatcagaccaattcgatgccagtgtatttggtaagaaaccaattatcatcgtaggtggtgtcgccatgcaaaaactggaggaattaggaatcttagcaggtttcaatgcggaacaatttacagatggtggtgactatgaaggtctcatgcgggctattattgatgataaagatccattaacaagtggctacgccatgaatggacttttctattccaactccggtaattggattgaaggcattcctgaaggatttaaaacgcttgttaaaatcgctgataaagattattatatcgcaggttggtggcctggtcatgacaaattagccaataaaattgtcgccatcgctggaaattatcaagaccaacctgtctttatctatgcaggtaatccaacaaacaaggtccaccctgttcacttcttccgttgggtgtccaacgccctatttggtagtcaattagcaagcttagaagacttaccagctgtagaaattcttgtaccacaacctgaaatgccaaaaaatattctggatgaggcgccaaaaactactacagtagtacataccaccaagtctaccgaggcaaaacaactacctcaaacaggtgaaaaaacaaactatatagctatcgcattaggtagcctacttctaggcagtatcgccttacgtagaaaagagcgtagctagtctacacgaaaacgccgagttttatttcggcgtttttctatgcttattttaaattaaatactgtactggccaagtagtctgctattcttggaaagagagtatagagtttatgagcagctgctagtgaccaaggcagattgatgtctcgtttcttcgtccccatagctgaaacaatcttcttggcaacatagtctggttgcagcaagaaagccttgacgctctcttgatagcttccatccgggtcagcctgatcgaaaaagctggttgcgattggacctggattgaccgttgtaactgtcacaccatactgggctaattccaagcgaatggtattagaaaaacccatggccgcaaacttggtcgctgaatagaccgaggacttagctgaagcaatcaagcctgacatggaaatgatattgataatctgcccgctccgtcttgccttcattcgtttacctactaaacggcacatggtcatcagagcaaaagtattgatatcaaacatggcctgcacctgctggctggaaaaattctcaaaatcatcgtaaatggcatagcctgcattattgactagaatatcaatctgaccaaactgactatccagttcatcaaaaaatgccgtcagagctatttcgtctcggatgtctacatcaaagacagcctttttttcatggtaagcatagagctgctcaatttttgccacatcacgacctagtaaaatcaaaaaatcatctttcagcaatggcaccatttcctgtaccaaaccaccagaggcacctgtgattagaatggttctcatagctcaatttcctctaaatctttgacaatatgaacctgctcgaaaatagtacttgcatctttccgtaattgactaatatccttggataaaaatcgtggactgatatgattaagcaagagctgcttgacacctgcatccttggcaacctgagcggcttccatattggtcgaatgcccgtgcttgcgagcaatcttctcatcgccttttccgtaagtcgcctcatgcaccagcacatcagcattaacagccaagcgtacactggcatggcacttgcgcgtatcaccaagaatggtcactaccttaccaggccgaggaggagaaatatagtcactcgcgataatttcagtcccatcttctagcgtcacgttttgaccatttttgattttaccgaataggggaccaaatggtacacctgccgcgcgcagagcctctgcatccaatgtcccttccaaatctttctggatgacacgatagccgacacaaggaatggtatggtccagcttttcagcgaataccgtgaatttgtctgtttctaggacctgacctaccgtatcaacatcaaactcatgaaaatgaatgcgataaggtaggcgtgtccctgatactttaagacttgccaagacaaaagaacggataccaacaggtccataaatatcaatatctgtctgctcctcgctagactggaaagaacggctagacaggaaaccaggcaagccaaaaatatggtcaccgtgcaggtgggtaataaagattttagccaccttgcgtggacgaatggtcgtttccaaaatccgattctgagtgccctcaccgcagtcaaagagccaaacctgattgatttcatccaagagtttcaaggccaaactggatacatttcgagccttggagggctgaccagcccccgtacctaaaaattgaatttgcattgtttactttctaatgttttatatataaaattgcagagcgacccgaccagacatagtaatgctgaccagcatagccgtccgccacttccagcacttcttcctgattaaagcctgaaatcttgaccaagccttctccggttgccacctgggttaaaaggtagtctgtttcaacctcctctaactcggcgtcctcaaagggattgactttcataaaaatcttgccctcctccacaaagacgacatagtggggaaagacttgggcgatttcaaagagcaagctatccgtcacttcctctcctacttccgaaaaaacctgggccagaccgtccgccgacacataggtaaatccgaaagacttaccagataaattcaggcggacaaagggcttgctttcagcaaagctgggttcttttggaaaaaggcagagctgctgagaaagagtgagatagtagtccgtcgcctcttctgccccttgtttctggtagatttccgcaaaataggcattgataaccgaaggcggtggcgtgataaaatctagtttttgttggtcagtcatatcagccaatttcctagccagatagaccttgtccaggctggtaaaaccaccgtatttgattgccaaatcaagataatccgtcataaaattcttccaacttccatttattgctggaagcgatatagcctgataccacttccacatcctcttcgtaggtccgattttcaatcagagccagagtagctaaatcatgcaatttataagattcagcaagtggcaccctgacctcaaatcgttcaaacatggtctttatcttggccaagaccatcatctgaatatggcctttggcattttcatccttagtggacagcatgacatgaggaaactgactgggggtaaagctgtcatcggtcttgtccagcttgttgtagagagctagacgtggaatgtccagcatatccaggtcttttagaatgtccaagaccacctgctcctgctcactgtgattggggtcagaggcgtcgatgatatggagcaagagatccacgttcatggactcctccaaggtggacttgaaggcagaaatcaactcagtcggcaggtcctgaatgaaaccaaccgtatcggtcaaggtcacattaaatttgtctgccaagttaatctgcttggttgtggcatctagtgtggcaaaaagttcatcagcctcgtactgtcgcttgtccgtcatggcattcataatagtggacttacccgcgttggtatagccaatcaagccgattttgaacacgcctgattgcaaacggcgttcacggacagtcgctcggttcttctccactgttttgagttggcgctcaatgtcatgaatctggttgcgaatgcttcgacggttgagctccaactggctttcacctggtccacgagagccgataccacctgcctgacggctgagcatgatgccctgtccaaccaagcgtggcaacatgtacttgagctgggctaggtggacctgcagttttccttcgtgactccgtgcccgcatggcaaaaatatccaaaatcagctgcatacggtcgatgaccttgacacctaaaatctcttccagattgacattctggcggggtgttaatcgattgttgacgatgacagtatcaatctcgtcagcttcgaccatctgggcaatttcgtccagcttaccagaaccgacaaaagtcttgctgtcatatttctcccgcttctgcgtatatactcctttgacgagggccccagcggtcttagccaggcttgccaactcttccatggacacgtcaaaattatctgtctgctgcaattcaactccgaccaggagggcacgttcttgttctttctgggtttcaatcatctaaaaattcctccacagcggtgtaaatcctatccttaacagcttcttctgatacttggtaaaaatcgactgccatgcggtttctaaaccaggttaattggcgtttggcaaagcggcggctattttgtttgacattatcaattgcttcttctaggctgatttgaccttctaagtaggggaaaaactccttgtagccaattcccatagcagcttgagcttctgggtgttcttggtagagccagctaacttcatccagtaagcccgccgccatcatcttatccactcgctgattgatgcggtcgtaaagaacctgtctgtcatccgtcaggcagatgtaaagaggctcatatcctgactctgtattttctaagttttcgccaaattttttcaattccagtccacgaatgattctccgtcggctgtttccctcgaccatcaaacctgcctgctctgccattgtttccaaatcctcgtcagacaagcagtcgagttccgcccgataagcaagtacctgctcctggtcaaccagcccgcccagatggtagccttcaagcaagctctgaatgtaaagccctgtcccacccacgataataggcaacttgccacgacttttaatgtcagcaatcagagccttggcttctgctacaaattcataagccgaatagccctcggtcacatctcggacatcaatcaagtgatgaaccgcagcagcctgctcttcaggactagcttttgccgtaccaatatccagtttgcgatagacttgctggctatcaccgctgataatttctccattgtagcgctgggccaagtctatgccaagggcagtttttcctaccgctgtcggtcctatgaccacaataactttagttttcatctttttccttgaaaatattttgttttttcgctaaaatctattataacacaagtaaaggagaaataactatggctaaaggttttggtaaaggtttcttgacaggtgttctttctacagttgctcttgcagcaggcgcagtcttcactgttcacaaaacaatcattgaaccagaagaaaagaaagaagctttcattgaggaaaatcgtaaaaaagctgctcgtaaacgtgtggcacattaaaaagctggcaaatgtccagctttttttgtttgacaaaaaatcccttagaagctctgccattttcacagaaaaatgccagccttcttaagggattatactttataagataatatcttctctttcaatgagaacaatagtccacatcatggcaagtgtgacgatagccagagcaagaatcaatggcatccagtttccgaagattggatagctgtaaccgagaaggcctggtccaaatgctgcaatgagatagccacctgtctgcaccattcctgataactgggcagtagcctggctgttgcttgttttcaaagtaaagctcaacatcatataagggaagagggctgcatttgaaaaacttaaaataatgtgaagtgctgaccaaagaatgagattggtcggaatcaatgacatcatgaacaaaccaagtaaggtaacagatgaaatagccagcatgatatttcgacgcatttcttttgtctgacgagaaagaacagctgggataatcatagacatgggaatagctgtcatattgaagaaaccagccattagccctgcttctgccttactaaagccaactgattgagaaatagttggcaaccaggtaatctctgtatagtagaggactgattgtagcccaccaaatatcaaaaaggcaatcgctgctttatttttccagatagatgatttctggtttccttggttctcacttgcaaatcgatggttattttttacattaggcaaccagatcaggaaagccataaacaccaatcctgtaattaatagaataaaaaattcccaagaactagaggatacaattggaacagcaatcatagatgcaactgttgccgccacccccatgagagtgatataaatcgtcgtatacagaccaattttctttggaaaattagccgcaaccaaacttggtagcaaaacattaataaatgctattgtagcaccaacaagcattgtaccaatgtaaagggctggtaagttgagaactcgcattcctgaacccagcaccataaccagtaagactagggccattagtttttccatgccaaacttagccgcaagacgcggtgctaaggatgaacagagagcaaacatgatgagcggaatagaggttaaaattcctaatgaactcacttctactctcagtcctgctgccacatctatcaaaatagcaggcaaagctgtaaagggggcacgcatcacgacccctagcatgacgattcctgcaattataaatggtgattgttttttcatttttctcctaagtctcctaatgttcggatttcagcacttttgattataccatagttgacaaatgatagaaagttatttccttctattttttcaagttatagtttttaactatggatttgccatgaaaataactatttttcaaatgatagcttatgagttagaataggttcatcactaaaacgaaagagagacacacatatgacaacttcaagattccaattagtcggttcacttcttcgaccagcaaacttaggagaatttaaacgacaaatcgaagctcgtgaagacatcaaatacccattctatgatgacttcgatggttacaaagaaactgaagcttcactcatccaaaaaattgttgcagaacaaaaagaaaacggtttggatattgtgacagatggagaatttggtcgttcaatgtggcacctagattttctctggggcttcgacggtatcgagcgttacattgctgagcatggttatccatttaaagaccatgatggacagatttttgaaacacgtaaggatattggattgcgtattactgctccactttctgcaaaaaatcaccatttcattgatattttcaaacaagtgaaagaattagcaggagaaactgtaaccaaacaaactattttcggtccagcccatgcctttaatgaattgacaattttcaatggacaagttggaccaaatcaggtctacaagactcgtgatgaattaaaagtcgggctcatcgctgcctataaggaatttttagaccagtacaaggaagctggtggacaaatcgttcaatttgatgactgcctttgggaattatttgaccctgctaaccctgtacctttcttgccacaagacgattctgaagcattggccgctttggctgacgagtttgttgctatcaataatgctgttattgattacggacatgaaattggcttgaccgtctggacgcacaactgccgtggtaactatgaaagccgctctgcagctggcggaacttacgaagctattgccgaaaaattcctgcgtgaccaaaaatacgatcgattcttccttgagtgggatgatgaacgtgcaggtgatttaaaagctttggaaagcttgcgtgacaagaatgtcgaagtcgttcttggtctactttcaagtaaaacttctgatttggatgatgaagaacgtgtttacaaattactcgaggaagcaagcaagattattccaaaagagcgtctctacttgtcacatcaatgtggattcgcttcatgtgattcaggtaatgaattggccatcccgcaacagtgggcaaaaattaaacaaggccaagaaattgcagagaagttttggtcttaagccacttcttgttattcgtgcataaaagccctgtcatcaatcagtgtctctaagttaactctgatcagttaatctatgatatctaatcccaagtatttttccgatgtaatacttgggattttatgttcggacaacacaaagggaggcttttttatatagtctacaggtttatcacaattggccacgagggtttcatacttatcggtgccgaacatgcgaaaagaaagggagtaaaactcggtttcatgctgcttttcccatctcgaatccgaatcagatagaaccagcctttttattggtaacaatccataaagttataggttttatgatctctatccgctataatgagggctggttcgaaaatgtcgttaagatttaatctctaatccaacttgaagtactagcaatattttaatagatttatatgataccgttgacaaagcaacgttgtgacaatgctttaagggagtcgggcaataggattggtataacttgtgacaaatagttgatatttgctgtacgatgtgattttacgatatgctgtaagtcgcttatttggactaagttcctgtttgtttcatcgcttacagtatcgtccatttgggctttttattgtatattaaatgtaactagcatcacaattcttttatatatcagccaatgaaacaactactcttcgccattgtatttccgactaggctccccaatcgtttcaaaacttgctcgaccatccgcagccagagcctcctgctcataggcattgataatctgggcaacaactgggtgacgaaccacatccttggctgaaaaatgtacaaaatcaatctgcggaattttgcttagtttctctgtcgcatcaatcaggcctgacttaaccttgcgtggcaggtcaatctgactaatatccccattgacaatcatcttggaattaaagcccagacgggtcaggaacatcttcatctgcataatggtcgtattttgcgcctcatccaagatgacaaaggcatcttccaaggtccgaccccgcatataggccagcggtgcaatctcgataatctcgcgctccattaggcgcgtggtctgctccttgcccaaaatctggtagagggcatcatagacaggacgcaaataagggtctactttttcttttaagtcccctggtaaaaagcctaaactttcacctgcttctaccgcaggacgggtcaggacaatccgcttgacctgtccccgcttgagggctgttacagctagagtaaccgccaagaaggtctttcctgtaccagctggtccaattccaaacacgatatcatgacgctttacgctgtccacatagagtttttgtccaagggtctttacgcgaatgggtttgccatagttgtccttgataatctcttcttcatagagggcaacgaatttctcaatctcatcattttttgccatggaaatagctgtgaccacatctggcgtattgataactaaaccacgactcaccaagacaaggagagactggataacaagacgcgcctgttctacatgttcttcctgtccaatcacctgcactttttccgtacgggcatgaataaccacacctagttcctgttccatcaatctcagatggcgttcattcgaaccaaataggctaaatgaatcatctggatgcttgagttgaatatcaattgaatgttctagcaagagttgctccttttcctgtgcttttctctattataacaaaaatagcccaaacaaggctattttgtactattttatccatcaatgtcccaaataatcttcccaaatcgcatcaaaatcagacatggaaaaggcaaagctggccgattcctccaaaaaacgactgacttcatcgaaattatctgattgcttaggaaaatcagattcatcaaaggcataatctgccaagatagctactggttcattacttttcgggttgcgctgggtcatcaaccaagaataaaaacttcttctcactacatctactttctatgatttttttcgtagagctctatatagcgctccatagacatcttactaaccaattccccaatcaattcataaggaatattcttgggatttttcatacgaacacaggacttgcccatatccagtttggtaggcacctgtgcttgataagcagcaacgaaccaatcattcaattcttggtccatatagattcccatgtggtagagggcgatgtgtgccttttgtgatgccaaagcaaggaatggcaagggctctcccggtgtgcaatgataaccatcggggtaggcagcaagcggcacataatagttaatcatacctcccaagattcctacttcaaaaccagctggtaactgttccacaatcacttgatggagccgttcaactacttccttccgattttcaggcaaggcagccaaatattcttcaatcgtttccacttcaatcagcatgactttctcctatctcaaccccaacatactttccttggcatgaatcatatctgttatcatctgacagtatggcgtagagatacctgcacgtttgcccttaaaaacaaccgctccattcagataatcaatttctgtctttcgaccatgttggaccaaatcctggtgcatagatggatagtgattggaagccttcttcgaagcatcaataacatatttccaaatagcttcttcgtcaattccatctgcctcagacttagcaacagcaataaattctttgaaaatcccctgtactagatttagtccagcctccgtaccaaataattcaccaattgtacagtctaaaatggtacaagttggattcatcacaccattgacacaggctttctgccaaatagcactgacaacatgattgtcataggtcacatttagtccagcttcattcagcatttcaataatatccgcaactgattgctcatcaccaagaatatgctgaacggacatagaacccggaccttctaagtgagcatgtccaggaccctttagtcccgccaaccacatggtcaccccaaccataatactttcatctggcacgtaccgacgcatggtcgtcgcatgccccaaaccattcaagagactcaaaaccttggtagttggaccgataatcggtttaatatcccgcaacatctttggcaactgatcagcctttgtcagtagaataataaaatctgcttctctcgttgcttcggtcggtttcatgatgggtaagtatacagtttcctctacgtctccagtcactttcaagccgttttctcgaatcgcttcgatatgttcttcccaattatccagcaaaatcacttcatgatttgtcttagacaattgataaccaaaccgacaccccattgccccactaccagcaatatatactagcatagacgccccctagaccaactctgttccaaaagaatcctgtttaattttcccagccttcatcaaaccaccaagagcttttttgaattgccctttggaaataccaaaggtggccttgatgtcttccggagcagacttatcgttcaaggtcatgaaacctccattgctttccagataagtcaatatcatctgagcatcattttccagcatctcaaatgaacgtggcttgagagacaagttcaaggtccgatcaactgcacggtagccgatgacacgagcctccaaaacctgacccagacgtggttccgcaaatcgttcacttgggtggataaaaccaagcatgttgttgtctggcaaataaacaaaagtaccattcattttcaaacgatagacaatcgctcgcagattttggttttgcatattatcataagcaggtccagccattttctgaaaatcttcttgaaaagctggcagagcccaaatgcggtccttcttatcgacgtctaatttgacgtacaaccgatccccttttttcggccagagttccttgatttcaggcaaaatgtccaaggaaacaaccacttgcttgtctggtagacctgtatccacaaagacacccaaatccttacgtacctctgtgacagttccccaaccaaagctggtacgactcgccccaacttccttagttgtcaaacggagtttttgtttcatatcggtataggcaaatcctttaacagattgacctagactatgttcgccttcatccttagaaagagcaaaggttctaccctctttttggacaaagtaaaactgatcgttttcgtcagtcactaaaccaacgatatactgtgctaataaatcattcatgattttcttctttctgattaaaaagtgggggaagtcttgtctaactccccccattagatttcttattggttcaccactggaagttagacagcccagtgatgatctatttttgtagtctaaaaacgtgttgattaaacttccaacaattctttttctttgtcggcagtcattttatcaattgtcttgatagcatcatctgttactttttgaatatctttttcaagcgtcttcaactcgtcttctgtgatttcttttgctttttcagcttttttagcttcatccatggcatcacgacggatattacggatggcaacttttgaattttcaccgacttttttcacatccttcgccaagttcttacgagtttcctctgtaagggcaggaataaccaaacggataacagtaccgtcagattgcggtgtcaaaccaagatctgaagcgttcaaagcacgctcaatatccttcaagattgacttatcaaacggagtaatcaatagaacacgcgcttctggcactgtaataccagccaactggttcaatggcgttggagaaccgtagtactcaactgaaatacggtccaacaaactagcattggcacggccagcacgaatgtggctgaattcacgtgccaaactctgatgagattggttcatgcgctcttgcgctttagcaataatttctttagacataagacttccttctttgtatttttttacagtcttttagtttacttttagtactaggtaacgagccacaggcataaccgaagttagacaaggcgaattaacgaagtaataaaagaaaaactaaatgacgatatgatttatttttcttctgaagaatttgaaacggtagtaccgattggctcaccgaagacaacacgtttaatatttcctggttcattcatattgaacacgaccaaatcaatatcattgtccattgagagagttgatgctgtcgcatccatgattttcaaaccacgactaatcacttcacggtgggtcaattcattgaatttaactgcattagcatctttcttcggatcagcattgtagacgccatccacaccatttttagccatcaaaatcgcatccgcttcaatttctgcagcacgaagagccgctgtcgtatccgttgagaagtacggagaaccaataccagctccaaaaataacaatgcgacctttttcaagatgacgaagagcacgaccacgaatataaggctctgcaactgactgcatcgcaatcgctgtctgcacacgtgtatccacaccaagctgtttaagggaatcagccattacaagagcattcataacagtccccaacatgcctgtatagtctgcttgaactcgatccatacccgcttcagcagcaggctctccacgccaaaggttaccaccaccaataacaagggcaatctgaatacctgattctgcgacttcctgaatttcctttgccatttcctgaacagttttaaggtcaataccgacaccacgttcaccagccaaggcttcaccagatagtttgattagaatacgttcgtatttaggtttcatcatctctctcctcttttttatccctactattctaccacaaaaaccgttttttttatactgaaatctccaagaaaaaaggaaaatcctcaacgaactttccttctcacattctaaaacgcctctttttcccagcttttcaatagtagaaaatagagatctttaaaacaaactagcctaggcgcaatttcctccgtaaactctgagcccgacttccaattaaacgatctagctgacgagtcttcaatgtcaagatgacaaagacaagcatacctgctccacctgcaacagccaagtggataaagctagatacatagccatttgctggaaggataagattcaagacaaattcaatcccccatacaacgagtcccattacgatagaaatccaactaatggtcgcaatatcttttatcactagtctttcatcaatatgcagaaccttgtcaattcgcctatagaagaggtacagcataattcccaacccaaatatcgttgagataaagctaccatataccttaaagacatagatcattggtacttgtaaaacgattttcactagcatcccaatcaagaaataataaatggctcttctattttcaaatatcgcttgaatgaccacactaatgacagaatatagtcccagaggtaaaattaaaaataagttccaaataaatagagtaatggcgataggctctgacggtccgtaaaaaatcgtataaagtggcccagctaacaggactgttccaacaattgccggtatagtgaatataaagagtaattgtagattatccgccactaaatgagacgccgccttcaaatctttcttgacaaatttctctgtaatcaatggaatagcaacacttcccaaactaagtgaaatcccgataatcatcatcgtaatcttacttggattggcagccatatatgaataaagttccaaaagttccgaattactgtaatccgtaattctttccataacacgaataaacgtgacttggtcaataaactgcaataattgaatcgttagacctaaaatgataattggaatcgcatctcgaacagtttccttaataagttgacctgtatccaaagaaatcttttgtttcttagcatgaagcaacttaccaaggtaaccttgcttccataaagtataaactaaaatcccaacactagcaatcatcccgacaaaagctgcaaaggtagattggacaaccgcttcaagatagtcaccgctacccaacttcataatcataaatgttgctgccagtatccagataacccgtaccagttgctctgcaagctggctgatcgcatagggcttcatatcgtgccgaccttggaaaaaaccacgcaagatactcatggctgggaagataaagagaggcgggactagactatacatgactggaagtaacttttctttcgaccccgatgcgtctgccaaccacggagcacttagatacatgacccctgcaaagacagccccaaagaccaacatgagcttgaagaattctctgaccaagtaaagcgacacctcttctttacccaagacattgtatttagctacttgtttagcaatagctgtcggaagaccagctgttgaaatcaataagaagttggcatagatttgataccccatactaaagagggcattggcttcagctcgatattcccctaaccaaatataccagggaataacataagcaacaccaagcaggcgactaagaatatttccagcagtcaaccaagccaagcctctggccattgtcgcctgttctttggactgctgcatttcaactttttcggacatttttctattactttctatgtaaatataagacaggaaaaactcaattattaatttctatttttggattttcacaaagtctaactctttcattataaacttttatcataccaaagtaaaagaaaaacccacccataaggtgggcaagtcaattaattatcaattgaatgatatttcactgtcaaccctcgttgtacagctgggagctgagctattttatctacccaggtctttagatgcttgtaagaatcaacatctaaaaattctgccgaacctggatatagttctccttgcaccaagcgaccataccaagaccaaatagcaatatctgcgatggtataggtatttccagctatatattctcttgtcgccaatagctgatccaagagatctagctgacgcttagtttccattgtatagcgattaatcggatattcttgcgctgtcggagcgtaatggaagaaatgtccaaatcctccaccaacaaatggagcggcgccagtttgccagaagagccaattaagaacctctgtccgctctgcccaagcttttggcaggaaggcctcaaacttttctgccaagtagaggagaatattggctgattcaaagaccgaaatcggttcttgctcggaataatctaccatagctggtattttggagttggggttgatggcaacaaaatcggagccaaattggtctccttgaccgatattgatgagaaataggtcataatcagcttccgaaatacctaactctttcaactcctccaacataatagcaaccttaatgccattcggcgttcctaatgaatagacttggaaagacttctctccccttggtaggtcttgctcaaagcgactgcctgctgttggacggttgccagatcggttgtcattttcatcttcccacttccaaacgagtggttttgtatattctgtcatgttttctcctattttacctttcctggaaaaagactagcatagcgataatggttttgaacctcttgaaggtaatgggctagttgcaccaattccttaggcgctcggcaagtcagagctgttaactctgcattgataaagcgacttaagtgtcctgccagtatatagagattttcctccttgtccagctgacctgccacctccaatattttttcacgcagggcttctgaaaatgcttcctgcggaaggttgtaggctgcagaaaggtatttataaagctcttctttctctgctactttcatcggataactccttttatgtaaattgaatatagtataaatcgaaatcaagtgcttgtcaagaaaatctcaagaaaaaaagattgccctaagacaatctttctattgattaaagtgagttaggatcaactttgataccaacaccttgtgttgttgtaatagatactgaagtcatgtaagtacctttagctgtagctggtttagctttagccattacatcgtggaaagctttgaagttttcaacgagtttgtcagcgtcaaatgatactttaccgataagagcttgtacgatacctgctttgtcagcacggtaagtgattttaccacctttagactcttcaactgctttagcaacatccattgttactgtaccagttttagggtttggcatcaagttacgtggaccaagtacacgaccaagacgtccaacaacagccatcatatctggagttgcgataacaacgtcgaagtccaaccaaccaccgttgattttagcaacgaggtcatcttcaccaacaaagtctgcaccagcagcttttgcttcttctgctttagcaccacgtgcgaaaacaagaacgcgtgaagttttaccagtaccgtttggcaataccattgcaccacggatttgttggtctgctttacgtacgtcgatgttcaagttgtaagcaacttcaactgacgcatcaaatttagcgaagttagtttcttttgcaagagcaacagcttcttctacgctgtaaagttttgtgctgtcgattttttcaagagcagcacgcaagtttttactttttttagccatgttatatgtctccttgtaatcagataatcttgggtgctacttagtcagtaacagtgaatcccatagaacgagcagtaccttcgatcatacgcattgcagcttcaagagatgcagcgttcaagtcaggcattttagtttcagcaatttcttgtacttgtgcacgagtaactgttgcaactttagttttgtttggtgtacctgaacctttttcaacacctgcagcttttttcaaaagaacagcagctggtggtgttttagtgatgaaagtgaatgatttatcttcatacacagagataactactgggatgatcataccagcttggtcagctgtacgagcgttaaactcttttgtgaatcccatgatgttgatacctgcttgaccaagtgctggtccgactggtggagctggagtagctttacctgcaggaatttgaagttttacgagtttttcgacttttttagccatgatataaaatcctcctattgtggttttggcggtaattaaagatttttacctcccacaaatatgtgttttacacataccttttcattatacacgaatttcaaagaaatgcaagctttaggtttactttttttcacattttttatagaatgaatgtatgtttgaatcgattatatttttaaaaatagtagcctttctattcatctttctaaccttggccatttcgataattgctgtcaagttttttaggttgcaaaaccgaggatggaactttgcagacattgcctttcctctctatgcaattgaattttatctgatttcggacaaggcctactataacagtctactgcctcagcttgtcctagccctctcactactagcgattggtctttgcggtttcttccttttaaagaaaaagaattttttatatcgacgtttcttcaaggttttctggcgagctagttttatcttgacttttttgatgtatctagctttggttattgcggtcttcactttaaaatcctaaaatcatccatcctttcatagatggcataataaatccccattgcaggcgcagtggggattctttttatactaaatcagacaaggcgacgtagatgtatagtcgaatgaattagctttcagacaaggaactgaggtgcaggttgctagcacagcctagtggctgtgctaggttggagatataactttcaaagcaagtcacttctgcagagtacggcaagccgaaagtgacgatgtatcaaagttaattcaaatgactatagatagaactgaccttcatcaaatcaagtcaacagcgtatgattttgattttctaagagtattaattagttgtcatattgataggcctctctgggcatgaaaagatggacttattcatgaatttctagagggaggccatctggatcaaagaagaaggccatttttttaccatcaaaatcatctgttcgcaggacttcatgtcggatgtccaaacggtcaaactcttccagacaagcttccacatctgcaacctggaaggctagatggcgtaggcctgtatgttcaggattgggcatggccggacgcattggcgcatctggtttgatgaaaatttccaagatcagattgccttttttgacattgaagagaatatcatttttttctggtcggatatgttcatccacctgttcaaagcctagtttctcaacataaaattctcttgttttgccatagtcactaccgataattgcaatatgatgaactgcatcaaatttcattattgtgtttccaatacctttctaggttttgttccttcagctggaccaatgacacccgctgcttctagctcttccatgaggcgtgttgccctgttaaaaccaacagacaagcgtcgttgaatcatagaggcgctggctttttgtgtctcaactaccaaggcacgtgcttcgttgaaaagtggatctcctccagcatcaccaaaacctgcatcgccatcaccttctgccacttcacctggatcaaaggattcatcataatctgcatctgcctgatccttgataaagccaactattgcttctacatcatcatcggatataaaggaaccttgcaagcggactggatggttttcatcaatcggtttaaagagcatgtcaccgcggcccaagagtttttcagcaccattttcatctagaatcgtccgactgtctgtaccgcttgatacggcaaaggcgatacgagatggtacattggctttaatcaaacctgaaataacatcaacagatggtcgctgggtagcaagaatcatgtggatacctgctgcacgagccttctgtcccaagcgaataatggcatcttccacttccttgctggctaccatcatcaagtctgccaactcatctacgattaccacaattagaggaagtggaatctgtttttcttctgaacggctattaaattcttcgaccttcgcattataaccttctaagtttcggacaccaatttggctaaacaactcatagcgtttctccatttcatccactactttttgaagagctcgagcagccttgcgtgggttggtcacaacgggaatcaataggtggggaatatcattatagaccgataattcgaccattttggggtcaatcatcatgaacttaacttgatctggaccagctttcatgagaattgaagagatgataccgttgacagcaacagacttccctgaaccagttgaaccagccaccaatagatggggcatacgtgctaggttaaaggaacggacggaaccattgacagccttaccgagaggaatttccagaagtttgtctgggtctgttttagattgttcccagagctcacggaaaggtactgtagccacttcggagtttggaacttcaataccgaccagtgattttcctgggataggagcttcaatacggacatctttagccgcaagggctagagccaaatcatcagctaggttagaaatccgattgacacgaacaccgactgctggtttgacttcatacttggttaccgatggtccaatctcagctcgctcaactactaccttgattccaaaactggcaaaggtgtcttctaaaactttaatattctgacgaacaattcgtttttcattggactgactcttagcttttataggagcaaataagtctatggacggaagtttatatgctagtctctgcttaggcttgaaatcaatctgcacatctgtctcgtccttctcaaactcatttgtttcagaatcctggcttgccgagtttgattgtgctggttggtcatcttctgccaacataataggaaattcatcttctatgtctaagtggtcatattctgaaataatcggtacttgaacaggctcttcttcgaggatttcacccgtttctaaattgacatgtctatctaccagtgccaaagcccgagctgactcttcctcttcctctagacgaaggcgttcctcttctagacgagctaattcttgctgacgtttttcttctcgttctgcttttttctgtgttcgaagctctgctctttttacctgcgtctccaccaacttatctttggcaaccgccaagccatcggcaacatcataaacagaccatgggcttacaaaaaagataccaaatgctatcactagaagaccgatgaagaaggaaccgacatttgcaaagaggaaggagactggcagatagaagatacttccaatcatccctccgcctagaaatgctgttacctgaaacttagctaggtctgacaaggccaattttagagtatgaccgaataagtcactcccttgataggtccagtctaagtaagcctgaaattcaatcaataacccgataacaatcagccagaagcccgatatggtcccttctctttcgcgtaagactttgggaataagaaggtagataaatgcacccaccaataatagataggccagactaccaaataatagccggaaaatattgtagctggtcactccaaacacacctaggcgactggctgcaaaggcaatgaataaaagccccaatactcgaagggtgatatttttaacacgttcttgctgtgctaattctgccttggttggtcgcctcgtagcctttccttttttacttgtctttctcatagatacctcaactttctcaatctctttattttatcataatcgggaagaattttcatgatagaaaaaaccctgcaaatacagggtttctcttggagtgaaagaataatttaagagggcaaataatattatagagcgtttagaataatctgaccttctacgtagaaggttgatgtcaaggtttcttgaccatcgttaataaagatttccaaacagttggtgtcaaccaagacctctagctctgtcgcttgaaccgtgaccgctcgacgaacagttgaccattcctcctcaccaacttgctggattttgaggtgactacgatcaatatagacttcttgtttggctttatcatagccaaattgaagatagtctcggtcagtacccagtttcaagtctagactgtcgtccagtttgagggagagcttacttggtccttgaataacttgaccgatttcaatgtcgtcaaagctgttcaagatacctgctggcaagacctgcctgagtccattctcaccttgcttaagtagacgaggcagggtcatttgaccataccacttatggcctaggtcattggttacaagcggacgtccccatgtatgcatccaggcaatcatgacacgttccccttctggaccttcagtcgtttgagctgcatagaaatcatgcccatggtcgatttccttgaaggattctgccacaaagactttcttgtcccagtccacatgacccgtcacaaagatattggagttgatattgataaagtcattcccgtctttttggtaacgcattggagagataatcaggtactcttgaccgtccacttcaaagtagtcaggacattcccagacaaagccttggttggcctcacctttcaagaagatagactcaaatttccaatccgtcaggttgggagagctgagtaagacgatacagccgacattgtccttgtgcttggttgcgacaacagagtagtagtgaccatctttctcaaaaatcttcggatcgcggaagtcattggcaatcacttcttctggcagtccatctgctgttgcgactggattctgctcgattttttcaaagtgaataccgtcagtcgagaaggccatgttctgaacttgactaactgtcccgtcttcattgacgatgtgacctgtgtacatgagccagaggacatcatctttgacaatggcagagcccgagaaacagccgtctttatcgtaagctttatcaggagctaggtcaactggaagttgttcccagttgaccaagtccttacttttcgcatgcccccagtgcatcggtccccaaacactctcgtaagggttgaattggtagaacaaatggtattctccacggaagtagataaatccattggggtcgttcatccagcctgtttccggtgttaaatgggcttgtggtttgaaaatcggattaacgtttcctttttctttctgaataaattgattggcttctactactgttttcacaggcagcctccttttgattactgattttctttatactgatcatagtatttttgcttgatagctaaccagtcagaaagaccatagctttccaattctttcaaatagctatcccattcttcttcgataccgccgtttacaatccattctgcacgtttacggtagatgaagtcgttcatatctgcttcaacttgggcaatcttatccaaatcttcttgttccatgaagacgcgagggtaaatatcatcgtttgttacatagtcaagataggttgcgtgcatcaagtccaaacgccatttagcatcgtctggcatggttgttacggttccgtagtattcatcaagaatagccaacggtccaccaacttctgtcttctgacgaagttcacccggtgcggtaccctccaatggtaggtgtttcaaactattggttgctgtgtcgagttcaaaaatattttgttgggtttcatcaccataggtaccccagttgttttgaacagactggattggtttgtattgggcatcaatccatttagcagtcaattccaagtttttgttagctgaggtgataaccatgcggtcgcgttggaagcccataccgtttgtacgtgtgatgtgcttggttccatcaggacctgccaagactggcaagatgtcataagtatcgttcatacctgtaatgttagctttatcccaagtgaagtaaacaccgcatagattttcactacctttggcaatgtaagtattccaatcttgttcaaacgcttccgaatctagaagacctttttcttgaagggtacgcatgaactcaacaccttctttgtagtcttcgttgtctgctgtaaagtcaacggtaccgtcattgttgacaactaagtggtcatcgttatcgcctacaccaaaggcaccaaatagaattttaaagtcctcgttacctccaccattaatgaagcccatcggaatttcatcagccttaccgtttccatttggatcctgtgttttaaaggcttcgagaaccttaatcaagtcatctgttgtttttggcatatcaagtccaagtttgtccaaccattccttgttaatccaagcaatgtcattaacggtatggatagactccttgccctctcctaattcttcaatccatgggaatgagtagatatgaccgtctggtgctgtaatcatggaacggtactctggattttcatcaagaattttcttgaggtttggcatatgcttatcaatcaagtcttcaactggtacaataacaccttgtttagcccagttcatcaattccacatcagaagccccgtcattatggatggcgtctggcaaatcacctgaagcgatgtccaagttccgcttttcaccaaaatcagactggtagtttgtccaatcaatatgaacgccagtttcttcctctaaacgcttgaaaattaatttttcatttgaatcggctggagctagaggtgaactagctgtcataaacttaagtgtaacggatttttccaaagggaattgaacatctttcaattcataatcagggcttgaagcagtattttttgagccacaagcagccaataaaacggtacttgcaagaagtgtaacaactgtttttccaaatgtgtgtttcatcagaaacaacctcctgttttgttttctataaaaattttgaacaattttaaccttttagtgaaccagccataatccccttgtcaaagtatttctggaagaatggatacatgacaatgagtggcaagctagagatgacaatggtcgcatacttaatcatttctgcgattcgtttcatttcattcatggcagcctgggcaccaatcatgtccttagcaggctcgctttgaatgaggattttacgaagtactagttggagtggctccaagtctgggtccttgatgtaaatcatggcatcaaagtaagaattccattgaccgacaaaggcatagaggaagagcacaaacataattggcttagctagtggaatcatgattttccagaaaatctgaaattcattagcaccgtccattacggccgcttctaccaactcatctggcaagccttggaaataggtccgtgccaagatgatattccacacattgactgcaccaggaataataatggcccagacagtattcaacattcccaaatctttaaccaagagataggtcggaacaagtccaccaccgaagaacatagtgaagacaaggaaggcattgatccattttttcccgaccaaatcttttttagagagtggataggcagtcatgactgaaatagccacggtcacgaaggcaaaggagaaggaataaaagagggagttgaaaaatccgcgtaggatagacttgtctgaaaatacccgttgataaccttctactgtccagtcctttggatcaaagctaattcccttgctaagtaaggcctgtggatccatgaaggacgctactaagatatagaccataggcacaactgttatgagaacaagaaatgccagcaagattttattgacaaccagcattcgcttgtcaaattttgtgtacatttgtgtattcatacgaacctcctataagccttgtccgtcgttgatgcgtttgacaatcttattgactgcaatcagcagaataatattgataagtgcgttaaataagccaaccgctgttgaataagagtagtcccctgacaccaaaccgattttatagacataggttgaaatgatttcagaactggtcaggttgagggaagtctgcatcagaaaggctttttcgtaaccaacgttcatgatgcccccagctgctaagataaactgaatgaccataactggttttagtgctggtaagtcaatatgccagattcgttggaaaatatttgcaccgtctagcttagccgcttcaatcaaggctggatcaacattgatcaaggtagccgtgtaaagagtcgatgcccagcccattccctgccaaataccactgaggatgtagaggggtctgaagaagtctgggtctgtcaggaagttggcttcaatgccaaacatacctaggatggaattaaccggtcctcctactgagaagaagaggaaaatcataccgacgatgacaacgactgagataaagtttggagcgtagagcaccaactgaatccgttttttagccttatcgctcaatagttgattgagcatgatggccaaaataattggtagaagaaatcctaagagcagaccgtagacactcaatttcaaggtgttggcaagtaaggtgccgaaatttggagacgagagaaacttggtaaactcttcaaacccaatccactcactaccaagcaccccttttaaaggattatagtctttaaaggcaatcagcactccgtacatgggaatgtaacggaagatgaaagtcaagaccaagcctggtagtaacatcagtaacaagagtttctgttgcttgattctatcgaatagactagcttgttgcagttttgatgttttcataagaactcctttttgaaacgtttcatttttcttgtgaaaataaaaccaactgtttattgatggttttattttacaattgtaaccgttttctgtcaactgcttttttaaaaattttttgtagtttttccttcaagataggaaatcggtagagtgacttgtagggggcgctctcttttctcaataatatcaattagacaggcaacggcttcttgggccatagactccaaaggttgacgaatggtcgaaagggctaaagatttttcacttgccaactgaataccatcatagccaatcacctgcacatcttctggaacccgtcgtctcagtttttccaaaacagcaagtgtgtctagggccgtaaaatcattgatggtgaaaatagcatcaacctgtggattgttaatcagaaactcttcgacttgaccgacaaagtcatcatatggctcttccaagtccaagacatgacaaggaaaacctgcctctaaaatcctcttttcaaaatacaatctacgcttcttggtttcattgattgttttattgtgcccaccgataaaggcaaaatggcgacctccttttgctatcaaggtattcgctgccagttccgcaccagctcggttgtccgaactgacacaagggatagccttattttcataggtgcggtcgatactgacgaatggaatgttagaagataagtaatcctcgattggactgtaggtgatagcaataatgccgtccaccttattttgttgcagcatagtcagataatccaactccctttttggaccagaaatattgcaaaggagcaacttgtaatttttcttactcagttccacttcaacatgataggcaaattctccaaaaaaaggatgccaaactgtcggaataatcaaggcgatagtttcggttttgttcttcttcatgccacgagcataaacatctggaatgtaattcaattccttaatggcagcattgactttttcaagcgtactttccttaatacctggctcattgttgataactcttgaaactgtcccaacactgacccctgcaactcgagctacatctttcatagtaattgatttttgttcttccatggtttacccctttcttttgaaacgtttcaataatttacactagaatatcattgatagcgttttctgtcaagaaaaattgacttgttagcaaataaaaacacccaaaaagctagaatgattctaacttttgagtgccgtttaaaaatcttttctattttatttgtacatcttcttcattgggtgttttgcaagcacttctgggtgattatcgagtgcagctctgcctttttccgtcagggcataacctcggacggtaaagtatggagctaacttttcttccgtcaagttgtccttgagggcagtgtcgaggtctgccgccttcatcttggataggcctgtcacaccctctgctttgaggatatttttcttggcagtagaagtgatgtggtctagggaatcaaaggccgattccacataggcataaccgtctgcgatcaactgctccatgtgagcaggaccattgataccatacatgtactcaaagtacttggagtagggcgtcgtcgattcaaaagaacccaggctaatccgccatagcaaaataatatctcctggcaaaataccttcttccagacgaaccatattgcgtttgggaacgggcttggcctccaacagccaggctgccaagtcacgctcgggggaaatatagggtttgacctcgtggtctttatacatttcttcaacacgattctggagtgacatttactttacctcacgaattgcgtaataatttccatcattgtctgcaaagctaattaccttcatgaaaccaaggtccatgactggattcgttgtgacaccacgttcaacaagttcttcgtaagttttggctacatctactgatgtcattaagattgatggtgtacctaagtttaattctggctccatctcagcaacctccgccttatcatgaagtacaaattgtacctcactatctgatttaggtgcaataatgtaagaagtttgggggccttgcacttgtttttctacacgttcaaatcccattttctctttccaaaattgagctgaagcctcaatatcattcacatataacataacttgtccgattgattgaatcatcttaaatacctcttttgcgttgtacgaacatgtgttcaaaccattatacactagatagggatattctccaaagaaaaacgactcttagagccgttcaaaacctaggaaacgagtcccctgaaaatgcagggtgcctacatctctctctgctaaaagggcatattcatctgaacgaaggcgaaattcctgccgttttccctcccattcaaacgttacataataattggttcgtgctacttcgttaccaaaaacatgggttcgtttagagacaagcttagccttgcaagattctttgggcgcccgattgttgtggtgccattccataaaatttttaatgatatggaaacaaactgtcgctaatatgattgcggaaaaactgtagaaaagggccgtatgccatactaggcttccatctgggtcaaacaagttctcaaacatcattattctccttttacatctttaaatatagtatatcatattattgttttagatacgctttttatactagataaaaattgaaaaaatccatatttcatggtagaatgagcataattttgaacaagacaagaaaggattttcaatgaaaaaaatactagttcttgctctagcttcgagcatcttgctaactgcctgcacaaacaactcgacagctaatagctcatcttctacagcatctagttctagtccaagctcgactacgacagctgatacaactgcttctagccaatatgccaaagatttggcatacgccattaacaatcccaaagctacattcccccaactttccaatgaaattggtgaaaatgaggctgctattaaaataaaaacaaccgaaggcgacatcactataaaactcttccccgagcaagcaccactaactgtggaaaactttctgactcatgcgaaggaaggatactataatggaacgatcttccatcgtgtcattaaggatttcatgattcaaggtggcgatcctcttggaaatggtactggtggagagtctatctgggccggaaaagatactactatcgatgctggaaatggttttaaagacgagatttcagctttcctctataacattcgtggctcactttctatggcaaacgctggcgcgggaacaaatggaagtcagtttttcatcaatcaaaatacaacagacatgtctagccaactctctagttctagctatcctggtaaaatcattgacgcttataaaaacggaggcaatccaaacttagatggcaagcataccgtatttggtcaagtcattgaagggatggacatcgtggataaaatcgcttcagtcgaaacagacaatagcgataaacctaaaacagatgtaaaaattgagtctattgaaattctgaaagattacaccttttaaaaatgggttctataatttctgtagtgggtaaaaccaccgtggagattatggagcctttttgagtatagaaaaaaagtcccatatgacctataatgaaaagcaaccacactcacattagaaagactcatatggaacaactaaatcttatcacaaattttctcagaattaaagacaaaaatatcactatcactgatgaatatgatatgggaactcacttagaactccacggttacttggattacatggctcctaaatgtccagaatgcaagggacaaatggctaagtacgactaccagaaagcatcaaaaatcccttacctagaaactgctggttatccactccttatccgccttaaaaagcgtcgtttcaagtgtaaagaatgtgggaaaatggcgggcgctgaaactcctcttgttaagaaaaaccatcaaatctccgtcgctgttagtcagaagatcgctcaattactcatcgaaaatcaagcaatgacacatattgcacacaggctatctatctcaacatcatcagttatgagaaagctcaatgagttcaagtttgaaacggattggaataccctacctgaagtgatgagttgggacgagtatgccttcaagaaggggaaaatgagcttcatcgctcaagatttcgactccctaaacgtcatcgccattctcgacggaagaactcaagcaaccatccgaaaccactttctacgctatcctagaaaggttagaaatcaggtcaaagtgattaccatggatatgtttagtccctattatcaacttgctaaacagctttttccgaatgcaaaaatcgtactcgaccgctttcatattgtgcaacaccttggccgtgctatgaaccgtgttcgtattcaaattatgaatcaattcgacagaacctcgcaggaataccgagccttgaaacgctactggaaattgattcaacaggatagtcgtaaactcagcgataaacgattttatccccctatgtttcgaatgcatttgactaacaaggaaatactggaaaaactcctgtctttctccgaggaactacgacagcactatgaactctatcaattgctcttattccatttccaagagaagaactcagaccatttctttgacatcgtcgaactggaaatagccactgttaatcctattttccagacggtatttaagacatttctaaaggataaagacaaggttttgaatgccctagaattgccttattccaacgccaaactggaagctactaataatctcatcaaagtcattaagagaaatgcctttggtttcaggaactttgagaactttaaaaaacgcattttgattgctttgaacataaagaaagagagaacgaagttcgtcctctctaggtgttagcttttcatctacccactacagttgacaaagagcctaaaaatgaagctgggcaagacatcatagatgtcttgcccagcttcatgtattctatcatatccttttatagttatctttatcaaggtaagctgattaccatcagctctcatctaccactagaaaaagttcactgaacctcgacgcagtaggcgtcacaacaaatcactcttcgcattgctcgagttctttggacgccgcccttgcgagggaaagacgacgaaatcaaatcaactttgttgattactgatttctgtctttccgctacatcttctcttccaactccacatccggatacttgtccgcgaaccagcggagggcgaagtcgttttcaaaaaggaaaactggttggtcaaagcggtctttagctagaatgttacgacttgatgacatgcgttcatccaggtcttctggcttgatccagcggactgtctttttacccattggagccatgactacttcggcattgtactcgccttccatgcggtgtttgaaaacttcaaactggagctgaccaacggcacccagcatatactcgcctgtctggtagttcttgtagagctggatagctccttcttgcaccagttgctcaattcccttgtggaaggatttttgtttcatgacatttttggcagaaactttcatgaaaatttcaggggtgaaggtcggtagcggctcgaattcaaacttgttcttgcctacggtcaaggtatctcctacctgataagtccctgtatcgtaaaccccgataatgtcacccgctactgcattttccacattctcacgggactcggccatgaactgcgtcacgttggacaacttggctcccttacctgtacgaggcaggttaaccgccataccgcgttcaaattcgcccgaaaccacacggacaaaggcgatacggtcgcggtgacgagggtccatgttggcttggattttgaagacaaagcctgaaaaatctttattgagcgggtcaatgacatcccctgtcgttgtcttgtgaccatgtggctctggagcaaattccaagaaggtgtcaaggaaggtctgcacaccaaagtttgtcagggctgagccgaagaaaacaggtgtcaaatcgccgtccaaaatcgcctgttctgaaaattcattcccagcttccgccagaagttcaatatcatccagaacttgtgcataaaaggggttagaaccaaagagcttgtcaccctcgtccaagcttgcaaaacgctcatcacctcgatagagttctaaacgtttgttatggaggtcatagagtccctcgaaggatttccccataccaatcggccagttcattggatagctggcaatgcccaagacttcttccaactcctgcaacaaatcaagtggctcacgaccgtcacggtccaacttgttgataaaagtgaaaacaggaatgttgcggtgcttaacaacctcaaagagctttttggtctgggcctcgatacccttggcagagtccaccaccatgacagccgcatccaccgccatcaaggtccgataagtgtcttctgagaagtcctcgtgccctggtgtatctaggatattgacccgcttgcctgcatagtcaaactgcatgacagatgaggtaacagagataccacgttgcttctcaatatccatccagtcagatttggcaaagttaccagtctttttccccttgaccgtacctgcttcacgaatctcacccccaaagtagagcaactgctcggtaatggtggttttacccgcgtccgggtgagagataatcgcaaaggtgcggcgtttcttgatttcttcttgtagtgacataatgtttccttttcattttttgtattttgattcatagcagagctgagctcttatcctattcgatttacattggattcatccttattctttactagacaactctcttattatatcggaaataagggaatttttcaaactattgaagaataggtctacagacctatactattgtattataaatatgttacaataagtatgagatgtattctatatactagaaaaagaaagataaaataatgaacaaacaaataaaaggtttatcaaccaaggaagtacaagaacgtattcaaaaccagcaaaccaatcattttaagacaaagaccagtgccagtaattgggaaatcttcagacgaaatgtgtttacatcttttaacgcactaaattttgccattttcttagccttactagctgttcaggcatggtccaaccttttcttcttcggagttattgtcctcaacgctgtttcaggaatgctgacagaatggcgagcacgacgaatgattgacaaactcaacctgatgaacaaggattttatccgagttgttcgcgatagcgagacaatatctattgcaccagaagatattgtcttagatgatgttctcttgctgtctgctggcgaacaagttcctagtgatgctattgttttagaaggtatagccgagacaaacgaggccatgttaaccggtgaaagcgacttgattgtgaaaaatactggggctgaattattgtctggtagctatctagttagcggacagatttatgcaaaagtcatccatgttggcgcagaaaactatgccaataagctcatgcttgaggcgaaaactcacaaacctatcgtctctcgtattctttacaatatggataaaattgctaaatttacaggaaaaattatcattccattcggacttgctctttttctagaagcctttttcatcaaaattcttcccttaaaagactcagttattaccagctctactgccctactaggtatgttaccaaagggaattgctctgctgaccatcacttctctcttaactgccgttatcaaactgggaatgaaaaatgtcctcgtacaagaaatgtattccgtcgaaacacttgcccgagttgatgttctttgtttggataagaccggaacgattactcaggggaaaatgaccgtcgaaaacctgctccccttaaccaaccattattcacttgacactatccaacagatactcgctacctatatccagacaagtgaggatactaattcaacagctcaggccattcgaaaagaatatggtgatttagagcaccactataaagctagtcacatcatcccattttctagtgatagaaaatggggggcaatgacaatagaaaacattggtcacatttttctaggggcaccagaaatgttactaacacaaaatcctccttctgtttctgaggcacaggctcgtggttcccgtgtcctgattcttgcgcttagccaacagtcccttctttcttctcaaaatcagctacctgagaatattgaacctctagctctattagaaattgccgacccaatccgagaagacgccgcagaaacactggcctatcttcgctcgcaagaagtgacactaaaaataatctctggtgacaatcctgtgacagtctcacacattgccagggaagctggatttgctgactacgatagctatatcgattgttccaaagttgacgacgaagaactaattgccagagctgaaacaaccgccattttcggtcgcgtatccccacatcagaaaaaattgctcatccaaaccctcaaagcacagggacatactactgcaatgaccggtgatggggtcaatgatattcttgcactacgcgaagctgattgttccattgttatggcagaaggcgatcccgctaccagacaaatcgctaatctagtcctcctagattctgaatttcgcgatattcctgagattctctttgagggacgacgcgttgttaataacatctcccacattgctcccatctttcttatcaaaacaatctactctttcttacttggccttatctgtatcgctagtattgccctaggtaaagcagaatatttgttagttttcccatttattcaagtacaaatgaccctcattggtcaatttgtcgaaggttttcctccttttatcctaacttttgaacgaaatatccgccctgtagaaaaacattttctcagaaaatctcttctcttagccctaccaaatgctctcatggttgttctcagtgtccttattttccatttaatgcaagtatttggatacttaaacttgcatgacatgcaaaccctttcttattatgttcttggttcaacaggtctactggctgtcattcgtgcctgtttgccactgacaaaagctcgactggctcttattatttattccgttttcggtttcttcatcagctcccatttcctacatggtctgattgaaatccaccccctaaacagtcacacattgccaatctattctggattaatgctcatttttatccctgtctttttctggattagctacaaacaaggcgcatttaaaaactaaaaataagacttgaaaaactaatttcaagtcttattttttcaatatatgcgaattcatttgtttgctttcttttttcaaataggcaatcagcatagcttgtatactcaaaatagagaaacagagtaggcaggttaccaagaagaaattcaaaggaagattattagtattcactaaaggtgcctgtctcaaaaatccataatttccaccagttaaaagagctactcctagaatcagcatattcataataagcgtatatttcactacctcttttcccttcaacatctccccttctaaatcagataacaggtacaacatacaattaaccgtcaaggcgtagtgaccaataacaaaagtaaagaaggtcagatgtggaaatgcaaatgggtcaaatactggatgaataaaggccgcaagcgatccaaaaagaccgagataggcaaaataacgtttcaaaggtccgggcttcgcccaaagaataaagagcatggccaagcgacaatgataaaaaggaagactctctgaaagaggagaatcagctacgatataccaagtataaagggagacaatctgtataaattgaagccaccaaaaaacaatatgaaaccatcttttttgataacaacgaaaacaaagatggagcatgaaaaaccaaataatcatgagaaacagatgttccaatacgttcaggttcggtgcttcagaaatctgattgctaaaaaaatcactcatcttattaaaatcctctctttcctcaaaagttagtatatcaacttttcgatgttttgacaagacttgctaaaaaagagaggtctctcctctctacttttctattgcttccactactttcccaagattcatggaattagagcctttaaagaggatttggtcctcttttcctagactttccctaacctgtttaaccagatcttcaaattgatcctgctctgcatttttcctaaagaaatagacttttccaatcgggaacatctgactagccaactgggccagaccttcaatatcctgaccgtagaaaatgacggtgtctagcacatcaggcgacaggctcaaaatcatctgattgtggagatcgacggactggctccccagttctttcatatctgctaaaacggcgattttcttgccgccttcgtttgcaggaatgctagtgaaagtttccaaaatcaatcgcatggccgttgggttggcgttgtagacatcgctgagaatatctgctccgtttgctgccttcttccactcggtgcggtttcgggtcaagtttagactggctagggctgacttgattgcctcatcaggcacacccaaggtcttacctacgtagcttgctaccatggcattggtggcattgtacttacccgttactgggaggaaaatgtcgccgtccataaaattgacggtgaaggtcaggctatcttttgactcgaccagactggtcacctgcaaatcagcctgctcaccgaagcgaatgaggtctacatggctcggcaagagcttatccgcaatcggatctgctgggatcaagagtttactacctggctccattccatctgcaatctgtaattttcctttggcaatctcttctcgtgagccgaaaaattctaaatgcgcttcaccaaaaagggtaataactgatagacttggtttggcaatttcggatagaagatgaatatctcccaagtggtcttggcccatttccaagaccagtttttctgtatcatcaggcatgtggaggacggtgtatggcagaccgatttcgttgttgtagttgccttgtgtcttataagtcttgtaagtcgtcgccagaacatcgtgaatcatgtccttggtggtcgttttaccgtttgatcctgtcacagcaatgacttctacccctgttttctctaggtagtaagccgctaattgttgaagcgcagccaagcagtcctctactagaatgtgaggaacatcaaggctaacttcagacagggttactacgcagccattttcaaaagccacaggaataaagtcatgaccgtcacgcgcacctttaaggggaacaaagaggtcgccagttgtgacgagtcgactatcgaactcgaccttgttgaatgcagtatcggtataaagactaatatcattttttgcgcccaagacctgagcgacttcgtgtagggttaatttcattgttttctccaataaactaaaaaagagctttcgctctttctattataccactttttatcgaacttgagtgaggacaccatctttcatctcataaaccttgtcgcatttcttcaattgctaaaaacatcttactccacactttctaagacataaaaacttgtctcaaactgcaagtcttccctcaaaagagctttgactttacatttcttttccacataggcaagaatctctttctgcttctgcgctgaaaccgactcaccaattccaatcaacacctcaaaacgctgattgtccaagcgactctccacctgaacaggcatggttttattgccttcttggctggcatagtagccctgcacacacatggtgatacaggcagctaagccaatattaactagactaaccggagtctcacccttctccgttaccccaaaggtacgaaccgattcgccatatccttgagaaagagcctgaaacagaccttccccttttactgtcgtttgatacataaacacctccagaacttgttccattttatttctttttgcaaacctttgcaagaaaaaagattggaatgattccaatcttgataataattaaatgaggtgactttcgcgtttttcaaacatttccttagccaaacgaacaagctcttcaatcaagtctggataagctaggcccatattatcccaaaggagtggatacatagaccattgggtgaaacctggcatggtattgagttcgtttaggaagatgtcgccgtcttcagtcaggaagaaatcacagcgagaaagtccacaaccaccgatagcacggaaggccttggcagcattatcacgcatgatatccatgatagactcatcaatcttagctgggatttccatggtgattttgttgtcgatgtatttggcatcgtagtcataaaaagcaacgtctttgactacttcgccaggaagtgtcgttttcacgtcagcatttcccaaaagaccgacctcaatctcacgcgcattaacaccctgctcaacgaggacacggctatcatacttgaaggccagatcaagtgccttacgcaagccagctaaatcctcagcttttgagataccgacacttgaccccatattagctggttttacaaagaccggataagtcaattttccttcaatctctgcaatcttatcgtcgatattttcaccctcgataactgccacataaggtacctgggagattcctgctgattcaagtacgcgcttggtagtgattttgtccatagcaacgcttgaagacaagatattagtgccaacataaggcatacgaagcacttccaagaagccttgaatagatccgtcttctcccattgggccatgaagaacagggaaaacaaccgccttttcttcataaatatcgctcggacggattttttgctcttcaacaatcgtcgcgtttgtcatgagtttttcatcggcagacggtgtttgagaaaactcttgcgtcttaataaagtccccggtctggctaatgaaataggttttgacaaaaaatttatcataattgatagcacgcatgacgctttcggcagacagaacagatacctcacgctctgcagaacgcccaccatatagtaaaatcaaggtttcttttgacatatattttccttcctgtatcaacgctattactcttagtatagcataatttaacaaatcatagctatcctatctcaaaattaggaacgtatctaactacagaactgctatagctctgtgcggttttcaatagccctcaacagggtcacttcatctgcatattcaatatcactgcctaccgctaagccacgagctagtctagttactttgattccagcaggtttaaggacacgtgagatatacatggatgtagcctctccatctgctgttgcattagtcgccacaatcacctctgtcacctcattttccatcaagcgggtcagcagagttttcaggttaatatcgtctggcccaatcccgttcataggggaaatcaagccatgcaatacatggtagagaccgtgatactcttggatattttccaaggctgtaacatctcgactatcctctacaatcaaaatagtagactggtctcgcgttgagtcctggcaaatggcacaggggtcctgatctgtcaaattaccacaaatggagcaataagataggtctcgcttggctgccaataaattttttgcaaactcattaacgacatcatcctccatgccaatagtataaaaagctaaacgggtagccgtttttataccgatacctggcaatttagaatagctatcaattaacttggcaataggtgtagggtaaagcataagcctccttaattcattgggtgaagtgattgatatagattgataatttcttgagtaattgtcttagtagttgttgaactttgattggtcaagtttggtaggacaactgctaccgcaatttgaggattatcactaggcgcataagcaacaacgttggtattgaccgcagtaaccacatcaccagaagctgtcgttgtgtaggtttcggctgtaccagtcttggcactgatggtcacggccgcaccacgaccgatagcactacctgtattaaagcgcccactaccattgacaacttggtagaaaccttgacgaagaagagacatatcctcagcggaaatattaacctgattcatctccttaccagatacggtttcaattaattcccccaaaccaccttgggcattattcccataaattccctcaacgaggtgtggagaaatccgtgtcccgttattcgcaatggtcgctgcatactgtgccatctgcatcggtgtatagttatcaaactgtccaaaagcgttggtaataaagttggctgtcgtatacttatctggtaaaaatcctgtagattcgagtggaaggtcaatacctgtagaagcaccaagaccatattctgcaaaagtcgaacgaagcttagtcatggcgtttttcaatgtatcaccatcattcaaatacatgttagctgagtaggtctgaccgagtagtcccaaagcaatcttaaccatatagatgttagaagaatattccagagcctctgtcgcatcaatattaaaactaccataggccccataccaagatgtaattggtgctgaacctgcaaaatagattggttcatctaattgaatctgattaccactgataactccattttcccaaccagagctgattgtcgctcctttgacgatggaacctggtgtaaagacacttgtaatcgtaccaagagcatcctccgtaatagtacttgagcctttttcatgactatatcctgacatagcaagtactgcacctgtagaaggatttaatgcaactgcataaacaccttccgagtaaagcgcactaccagtagctagctcactttcaaagtattttctcaaaatagcattgaccccatcttgaaaggctaaatcaatagtcagtttaatattatttccctgctgtccttcttggattgtctcaatactttcgatatttccatttctatctaggtttatttgttttttctcacgttgaccttgcaagacttcttcatattgtttctcgaggtaggcagttcccacacggtcatttgaagagtagcccttggatagatagtattctgcatcttctgcaggcaaaccagcctgttcactcgttactgtaccgataatggagctgagggaagttggtaaaatcgtccgttgccagttattggtcgttgaaatgcctggaagttgactttcattggctacgatatgagcaacctgttcagaagtcagagtatccgttaccaaattaacagtagagaagtaagtagctccattcatctgcttgaagagttcaatcgctttattgtcttgctcagaatattgtaatgcttcggcagggatactatcaactgcattagaataaattgttgattcgctcaagtagttaccatcggaatcgtattttttatattttggcaaggcctcgactacctgacgataaacctcttcatctgccaaataataatcagccttatcacgttgagtaattgttacgtctgaaacattgacccactgcaagagtttattagctacttctttcatttcctgagcagacatcttgttgggacgtgtgaaggagacgacctgctgaatctcgttttcaaccaaaggttttccctgcgcatcgtaaatctgcccgcgaatagagccattgctgatgattttctgactggcagtagacagcttattactataaaaatcatgattgatgatctgcatatctgccagacgcaatatcaaaactaggaaaaggaaaatcacgatagaaaataaaatatttaaacgaagggaaataaaatttccatcatgttccaaaggcttgttctttctttttttcacttcaaagacctcattctagaaatatccttcttattataccacaggcaaaaaatattttttagacagagcctccttttcagaaaatattttcttgtgatttcttcacgagacaagcttgcactatctcccattgactgtgaacagatgtttccacaaactgttgatcatgggaaatcaaggggacacttccttcatattctttcaagaatgtttccaaaacctcaatagctgccatatctagaaaatttgtcggttcatctagtatcaaaagatttgcatccgccaacaataccttagctaaggagagacgaacacgctcaccaccagacagatttgctaccttctgctgagccttatcgcaagaaagtcctaacatacctaataaattgagaatcatcatcctatcttgaagagaggtacaactaacattttcaaaagcagtcttttcttcatcaaggtttatcaaatcctgtgcaaaataagcaatttttaacttaggattataatagcctgctaattctttcctaaataattttcggacaaaactagtctttccagaaccattcgcccccactaaggctaacttctctccaaacgtcatccctatctgagggacatcaaatagatacacttcatccatcaaaacttgaccagcctgcaagcgaaagagactgtgaagacccgtatccaaggcacctttcgcttccatctttacccacgtttcctttctaggttgttcaaccttgtccaaacgctctatccgtttttccaaatgcttggcagtcttggccatagacttggcttgactatcataggaccccatcatggcactgactttccactcagacgatatttagaataaatgtccacattcacttctcaaagttcgcgtcaacatctcagcgcagtggttgattggcagatttgttcgtttcttacactccaaatctgacctaatcaactgtgcgggggtgggatgacgaagtttttataattggttgacttctatcccactccctctcttccccatcttctgagccttggcttgacgttcatgttgggcttttttcatttgggcaacttttttctgataggcttcataagactcctgctgtccttctcgcctagcccggcgactttctacaaacgcctcgtaatttcctagataaacctgaaccttttcttcttctaaatgccaaatgtgactggctatttgattgagaaaatgccgatcatgactaacaactagtagactacctcgatagcgtttgatttgtttgattagcttttcctggtgttcttgatccagattggcagtcggttcatccatgattaacaactgtggtctttgggcaaaagcctcttgaatagacttccaaacctgttccccacctgaaagcgagctcctttcctgtaactggggtacataggcccagtctgcttttacctcaatctgaccggcaaaatccctatccagtcctagtaagattttcaaaaaagtagacttgccaactccgttatttccaaccaaaccaaccttttgaccagctagcttgaaggctcaactgcttgggagcaggaaagaactcgaccaagataaaaagagttcgtcttcccgcccccgcacagttgattaggtcagatttggagtgtgtgtgaagcacgaacaaatctgccaatcaaccactgcgctgagatgttgacacgaaccctgagaagcgaggttaagctttttgcccagcctctacgtcccgcaaattccttctctaatcgaatacattttattacttccatatagacctcttttcttcacaaaaagggccccaattctgcaaaatggacacagaaaaaagccatgcaaaacatgaccattccctatgggaaaagtcacacgaatagtaagcccttatgagcagtcttatcccttgtatagtcagttaatgtaacctcaccacaagttttaagagcaactaataagtagcttaattattcatgtaacttcacctcgtataattagtaatttcagtataacttagtttgtatcaattgtcaaatcttggtcaagggagtcgctgtatctggcgatgtgtcatagacttggaaatccactccaactcctaaatcagcctgcgccaactgattaaccatggtcatgtgagccaattccttgatattgttttcctttgacaaatgccctaggtaaatctttttggtccgatttcccaacgagcgaatcatggcgtcagctccatcttcattacaaagatggcccttatctgacaaaatccgttgcttcaaattccatgaatatgaacctgcgcgcaaaatttcaatatcatggttcgattcaatcaaataagcatcggcattttctacaattccaaccatgcggtcactgacatagcctgtatccgtcaacataacaaaggatttgtcatccttcataaaacggtaaaattgcgggcatgcagcatcatggctaactccaaatgactcaatatctaggtcgccaaaagtcttcatagcacccaattcgaagatatgtttttgagccacatcaatcttgcccaatttgctctccatagcctgccaggtcaattcattggcataaatgtccatgccatacttacgtgctaaaacaccgataccatggatgtgatcgctatgttcatgcgttaccaggatagcatcaatatcctcaggctttcgatcaatttccgccaaaagactggtaatctttttccctgataagccagcatccactaagattttctttttatctgtttctaggtaaaaacaattcccgctggaccccgaagctaaaatactataattaaaaccttttccgatcatattctcctattcttcctcatctgaatcatcccactcatctagtgcgatgtccttgctatacggcaagacaattgtaaacgttgagccatgaccatattcgcttttagcccagataaagcccttatgttgttttacgatttcttttgcaatagctaaaccaagacctgtaccaccttgggcacgagatcgtgccttgtctacgcgataaaatcggtcaaaaattctaggtaaatctgctttcggaatccccagaccttcgtctgatacggatacaatcaactggctatctgtggtcttcatgctgaaggtaattgtcccgccgtctggcgaatatttaatggcattatttaagatattatctaaaacctgagtcatcttatctgtatcaatctcaacccaaataggactgatttgatagtcacgaacaatcgtatagaccttatctgaatcagcatttttcatttggtcaaaacggttaagaataaaggtcacaaaagcagtaaagtttatcagttcgacatctatctgaccaacttgattatcaatgcgcgataagctaaggagatctgtaatcatccgcatcatgcggttggtctcatctaaggataccttaacaaaactcggcgccacagactccgtcagcgctccctcatccagagcctctagataggatttaacggaagtcaatggcgtacgcaattcatgactcacatttgacacaaacagcctacgttcccgttcttccttggcctgctcggtcatatcatgcaagacgacaaccaggccagaaatcagaccactctcactacgaatcgttgcaaaattagcgcgtaaagtcagaaattcttcgttttcattggtgtgatcaatcacaatctcaggtgtctgagccaacaaatctctcaatgtataacggtctgataaatctaaaacctctagcaggtgatactgctcctgctttgggttagataaccccaactgtttctgggccatatcgttaatcatgatgatccgtccgatacggtctgtagcaataacaccgtcactcatataggacaggatggacgtcagacgtgtcttttcttgttctaaattatcatgagttaagcggatgacctcggacaaatcattgagggaattagccatgtctgtgatttcaggacttcccctcatgtctaacagatctgcataattcccctcaattaaggcattgactttttgattgagttgtttaatttgcttattatcccaatagttttcaatcaaaaggaccgtcagagcaattagaaagccaatcaaaatgacaacaaaccaaaattctgccgtggtcattaaataacgtaattgattaatcatttccttttataaaatatcccactccgcgacgagtaagaatgtattctggtctgcttggtgtatcttcaattttctcacgcagacgacgaatcgttacatccaccgtgcggacatcaccaaagtaatcataaccccaaactgtttccaatagatgttctcgagtcataacctgacctaagtgtttggccagatggtggagcaattcaaactcacgatgggtcagctccagctctttaccatgcttcttagcaacaaacgcatcaggcagaatgaccaaatcgccaatcaccaactctggagttcctgttgactcaatatttgtctgcgtctctggcaattcactacgacgaagaagagccttaacacgcgcctgtaattcgcgattagagaagggcttggtcacataatcatccgcccctatttcaagcccgataaccttatcaaattcgctatctttagcagataacatcaagattggaacattgctggtcttacgaatcgttcgagcaacctctagtccgtccaattctggcaacatcaagtccaaaatgacaatgtcaggaaactcagcctcaaatacttccaaggcttcacgtccatcgaaagctgtcacaacttcatatccctcacgcgtcatattaaacttaataatatctgagattggtttttcatcatctacaattaatatttttttcattagaatcttacctttgctttatttcttctattatatcagacttacctaaaaaattcatatttcaaaaccatctgacacggtgatgtcacattttataacatacaacacattaaattgtcagaatttacttgacattgtatataggcaatgctaagatgggaatacctaaaaaacagtatgcaaggagaattttatggctttagtagaatttaaagatgtcaataaatactatggtgactaccacgccctacgcaatatcaacttggaattcgaacctggacaggttgtcgttctccttggaccttccggatccggaaaatctactctcattcgcacgattaacggtttagaggcaattgatgaaggaacgctcatcgtcaatggacatgatatttcctctacttctatcaaagagctcgtatcacttcgcaaagaagttggcatggttttccagcatttcaacctttacccacacaaaaccgtgttagaaaatgttaccttggcaccgattaaggttttgggaatcaataaggctacagctgaaaaaaccgctcaaaagtatcttgaatttgttaacctctgggatcggaaggattcctaccctgctatgctatccggaggccaaaaacaacgtgttgccatcgctcgcggcttagctatgaaacctgagcttctactcttcgatgaaccaacatctgccttggacccagaaactatcggagatgtacttgcagttatgcaaaaattggcacgtgacgggatgaacatgattgtcgtaacacacgaaatgggctttgcccgtgaagtagctgatcgcatcatcttcatggctgagggagaagttttagttgatacaacagatgtgaatggcttctttgacaatccgacagagcctcgtgcccaacaattcctcagtaagattatcaaccacgaatctgacaaagtaaaactctaggaggaagtctatggataagaaaaaaatcaacattttctttgcaattagattattggtctttggacttattcttctcgttttcgcaaaacaaccagtagctcaaacagaaacacccgcatccattactaatagtgatcaagttcaagctatcatcgatagaggcgtgctccgcgtcggagtgaaacaggacgtcccaaactttggctacaagaaccctgatactggtgaattcgagggaatggagattgatattgctcgcaaaattgcagacgaattaggtgtagatatcgaatttactcccgttacagcgcaaacccgaggaccacttcttgataacagtcaagtggatatggtcatcgcaacttttaccatcactgaggaacgtaagttgctctacaatttcacaactccttattacacagatgccgttggcttcttggtcaataaggatagtggaattaagacattcaccgacctggatggaaagacaatcggtgtagctcagggttccattacacgtaccctcatctctgaactagcagacaaatacggtatcactgtcaattttgcagagcttggttcttatccagaactctctgtctcgctacgtgctcaccgtacagacgcattttctgtagaccaatctatccttgctgggtatatcagttcgaaatctgaactcatggactttagcttctcagcttctgactatggaattgttactaaattatctaacaaagaccttaacaactacttaaatagtctcgtagaaaaatggactgccgatggtagcctacaaagcatctatgatgccaatggtctcaaaccagtcacagaaactgacgaatagaaaggtgaaacaatatgacagttttaacaactagtccttacgcttgggagaattgggtcagttatttcaaagattttccaatctttttccaaggttttctctttaccttagccatttctgtcggagcctttatcatggccatgtttttaggaattgtctttggtagtctctcttcaagtaaaaataaagttttaaaaatcatcgcacgtgtctatgttgaatactatcagaacacgccgcttttggttcagttcatgattgtttattatggacttccactgatttcaaattatgttctcatgccatccatctactggacagctgttatctgcgtcggactctatcacggtgcttatatcgcagaggtcattcgtgcagggattgaggctgtgcctactgggcaaactgaagccgcactttcacaaggatttactcagtctgaaaccatgcgaatcatcattttaccacaggccattccgaccattcttccacctttgaccaaccaagtagtaaacttaattaagaatacggctactgttgccattatctctggagctgatattatgtttatgacaaaatcttggtctgccatgaatgccaactacatcccagcctttgctggtgctgctttcctttacttcatcatgtgcttccccgtcgcaagctggggacgtcgcattgaagaaaagaataagtcagccttttcacactaaaaggaggttgaacgatgaattatgttttagaattactcaaaccttcaaccttccaactcttgtggagcggattgaagttaaccctttatatctcaagcatttcggtaatcctgtccattcttttcggaatgattctcgccatcatgcgcaatgggaaaaatccaattttcaagtggattgcaaccatctatatcgaatttgtgcgtaatgtaccaaacttgctgtggattttcaccgtcttcttagtcttccaaatgaagtcaacgcctgctggtattactgcttttactatttttaccacggcagccatggccgagattatccgtggtggtctcaacgccatcggaccgggccagaccgaagctggtttgtcacagggttttaccccagtgcaaatcatggtctatatcatcatgccacaggccattcgcaagatgctgcccgccatcatctctcagattgtgacggttatcaaggataccagtttcctatactccgttatcgctttgcaagaactcttcggttcgagtcaaatcctcatgggacgctactttgaggcggagcaagtctttgctctctacattatggttgccctgatttacttcagtatcaactttgctatttcaagcctgtcacgttatgtggctaagtcttgggcgagcagtatagaatgaaatttctcccagccaatcggttgggagtttttgctgtcaaaaaagaagccctttcggacttcttgctttatttattcagctgcttcagctggacgtgacttgcgggcaatatctgctaggatatggtccacaaattctgatacagactgagtttgtgttgccttacttccgtagcgacgaacgttgacagcattgtcttccatttccttgtcacccacgatgagttggtatggaatcttgctggtttggctctgacggatcttgtattgcatcttctcgttgcgttcatccacgtgtactcgaacgccacggtcttgcaattctttggcaaccttccaagcgtagtccaagtgagcttccacagagattggaatcatggtcacttgtgttggagccaaccaagttgggaaggcacccttgtaggtttcaatcaagatagcagtgaaacgttccatagtcgagataacaccacggtgaatcataactgggcggtgctcctcaccgtcagcaccgatataggtcaagccaaagcgttctggcaagaggaagtccaactgaatggttgacagggtttcctcgttaccaagggcagttttcacctgaatatccaatttcggaccgtagaaggctgcttcaccctctgcttcaaagtagtccacgcccatttcatccatggcacctttcaacatccgctgggcattttcccacatctcatcgttgtcatagtacttctctttgtcctctgggtcacgataagacaggcggaaacggtagtcgttgaggttgaaatctgcgtacacatcaataatcaactggagagcttttttgaactcttcttggatttgttcaggtgtcacaaagatatgaccgtcgttgagggtcatctcacgtacccgttgcaaaccagtcaatgcaccagatttttcatagcggtgcatcataccaagctcagcgatacgcactggcaactcacggtaagaacgcacatggtttttgtaaacttgaatgtggtgtggacagttcatcggacgaagaacaaactcttcaccgtcgcccatgtccatagttgggaacatatcttctgagtaatgctcccagtgacctgaagtcttatagagttcaacagaagccaatggtggtgtgtaaacgtgctggtaaccagaagccaattccttgtctgtgatgtaacgctccaaggtacgacggatagtcgccccatttggcaaccagaatggcaaaccttgaccaacttcttggctgatcatgaagagatccaattccttaccaagtttacggtggtcacgctctttagcctcttcacgcatttgaaggtaggccttgaggtctttcttgtcaaaccaagctgtaccataaacacgttgcatcattggattttcactcttaccacgccagtaagcaccagccacattgagcaattcaaaaatctggatacgacccgttgacggaacgtgtggaccacgacagaggtcaacgtattcaccctgcgtatagatggtcaaaccgccctcgtcatcagagtgctcgtgaatcaattccaacttgtaaggatcgtttttgaagatttcaagagcttcttccttagtcacttcacgacgttcagaagggaagttttccttgacaatcttcatcatttcttcctgaatgcgtggcaaatcttcatttgaaatctgaccagccgcattgtccgtatcatagtagaaaccgtcctgaatggctggaccaacgcccaacttaatgtctgggaaaaggcgacgagccgcttgggcaaacaaatgagctgctgagtgacgcaagatgtccaaggcatcgtcgtggtcaggcattacaatttcaagcgtgccgtcctcgtcaatggcacgagtagtgtcaatcaatttaccattgaacttaccagcaagagccttttttgccaaagacttgctgatgctctctgcaatttcaaaagtagtcacaccagcctggtactcgcgaacagcaccatctgggaaagtaattttaatcatgtttatctcctttttatttatttttaatccccaataactcttctttttgagctaaaaaggtttccatttctttttgaatatcaatatccaggcggtcggctaattcgatcaaccaccagatattttcagccattttatgctccaaggtataaggcgtttcgtcatagtaacgaccctgcttggtcataatcagtcggttcatgttgccaatatcattggtcaaagccaagaggtcctcatcaatagaccactctttgtcatggtgcttgatttccaactctctataagcacgacgcacatcttgacaccgtcttaataagtcatcaggtagcatcattcctcctccaaaagaaaatacgacgccctcgtaaaaggacgtcgtaacgtggttccaccttcattcgcagtcacgcaaaaaagcctgactacctcagattggcgataagggaaccacccttttatgtttgcataaaatcataccgagtagtgtcaatcctatcctctatgtgcttgcacccaccgcacactctctcaaagatttcctagaattgataagtctctaaaagctattataacaggatttcctgatttttcaaggatttttcctcattttctttcttagagaaaatagcagagctcctatcccatttccaatcagagcacataaggtgtagacaatctgatagagaataatccattccttaaagaaaaagatggttacaggataaagtagtaaaaccaagacaagaaggctaggagaaaaaccgtgaaaaaatccataaagaagaccagttaagaatagcacaatgggagtatagagcaatatatttccgaccaccagttccttagaaagcatagtatcactaatcagatgaaaggcaatcagataaatacctgcatacatggacagaataataagagttgccaaaaccagattcttccaactctctttccgaagcttttccatttgaaacctccaaattattcaaagaaattccggattgattttacttgttcgactgattttttcaatatttttgctgtcgtgtctgttgatttaactactactttttgcggtaggtaaatagcctcttttatcaaagcttctgctacgctatcttgattagtatgttcttttctaaaatcatacgaaatcttcaaatctagataatattcaaaaaccttacgtccaaaattcgtagaagaaatctcatagagcttcttatcaagcacatacggattcattggtggtgtagcaacaattgcctcaacgacggcatctgccaactcctgttctcgaatgaagagcgtcccaaacatcttatctgttataacgttttttaagtagggattgctatgtgccaaaataggagttccagaagctaaactttctaagaaagttagtccctgtgtttcactggtcgaagcagaaataaagaaatccgcagctttataataaagtgctgtatcacttggtgcaatcattcccgtcaactggacatgttcatctagattaagctccgctatcatttcctgaagatcatctgtataaggtccacctccgacaatgaccaacttcacctttggattttccagcaaaatttttggcattgcctgaacgattgcttggatattcttctcgtgagaaatcctagacagacttaacaacatcgtttcatcactagcaattcctagctgttcccgcaactcatctgtttcatccttgccaatttctggtctatcaaactttgccaagtcaattcctgtcggaattactcgtttagaaatcggaacattgtaactcattaaaagatcttcaacgatctcactaggacaaattaccccatccaaatcttttaaaaatgcccgtactaaatatttaaccatcccgggacgaataatcctccccttggcaatatagtgtacgtagtcttcatactgggtgtgataagtatgtaccaccggaatatctagttccttggcaatcattttccccaaaatccccaaagaaaattctgtatgagtatgaataatatctagtttatagcgacttgcaatttttaaggcatctgtaaaacctgcgtaggccactcgacgatctttaaaggcaaaaaaaggtacgctaggaattcggataatgtcccaatcttcgtagcgattcacatcctcatctgtcgtcgtaaaaataaataccgtatgtcccaatttctccaactctgtcttaagagtccgaatcgaagtcgcgactcctgaaacctgtggaaaataggtatccgtaaacaatccaatccgcatttacatctccaatacttgtcgataggcatccaccaattggtgggaaacattgtcaatcgagcgactaaccgcaacctggtagcccgcctcacgtttatcaacctgcttgtctaagattttctgaatagaatcgacaaaatcatccactgtatgtcccaattcggcaacgttttcgtcaatccaaccatcgtaaactggaatatctcttagaacaacatgctgatgactagcaagagcttccagaacaacaatcccttctgtttcctcatacgatgggaagaaaaaggcattcgctccgctcattgcaccttgaaaaacagcacctttaaaataacctggaaactcgacattcgctggatgatctccctcaacaatttttctaatatatgacggaatcagccacttattgattgaaccgagccaaatgaagcggacatgcggcatcttttcggctaccttgacaaagtcttcaattcctttacgtcgaaagtagagtcctgcacagacaacaaccggctgcccttcttcaattttaaaatgctctcgaaagattgcttccttgcgttcatccttcttatatttatctaaatcaataccattcgaaacggctataattggcgttgtcacaccgtaagactggatgagtttttttgaatactctgaaggagtgatgacaaagtctgccttttggtacatgcttgctagatatttccctacaaaaggagctagggtattcgaaccgataaaggaattttgaaaatcttccttcgtggaatgtccatgcatgattaccttttttccactccgtttggctgcatgtagcaataaccaggagcgtggaccataggtattgatatgaatgacatcgtaatctcccagcaggtctgttgtataaggaatgcctgccatatctagcgcttccatctggtgttgaagtgcccggccaattcctgatttctctaaaacagttttaccttctaaatacaatagtactttcataataccattatagcccttttttacattttttcatattttaaactgtattctacacgaattttgtatcaattaaagccaatactaaagaatataatcccaaatatatgattacataaaaaacagataaaacagattttaaaagcagaaggacagcttgaatgttttttagaagatgttataatttacgaatggtgcacattctggcactaagtgttcaaattttattgaggactttagatgtaaaatttgcatgttataacgacacagattagctacataaatcatgctttgagaaaggaaaaaaggataatgaatactaagaaatggagaacatcgctcctaataccaggaatagtattatttggaactgttgctctagtgaataatgtatcggcacaagaagtaaaaaataccatcatcagcgcaaaacaacctgatgggggacaggctacttcaaaggcggttaatgtcaaaataccagcagtagtacgactatttggtcgtgagcttctagaaaatgaatttaaatttgagcttagagaagcgaatggcgaggaactccctgtccttgatacagctcaaaatacaaaagagggtcaagttagatttaaaaatctatcattcgataagcctggcaaatactggtatacaatttcagaagtaaaagatgagcttggtggtattgagtatgattcgaaatatattgtagcaaaaataactgtagaagatcgaaacgggcaattacaggcaatgatcgaatttattgataatgacaatgtctttaacaatttctatacacctgctccagctgctgctagtctttcgataaaaaaagtcctcgagggacgtaccttaaacaccggtgaattcgaatttgttttaaaaaatgaaaaaggcgatgaaatcgaaaaggtaagcaatcaagcagatggttctgtaaactttagtgccctaacatttacaaaagagggaacctatacctacactgtttcagaagttgatggtggacttggcgatattatctatgacaaatcagatattaaggccactgttactgtgaaagataacaatcacggacaactagtctcaacagtgacttatgaaaatagcgatcaaatcttcgagaatattttgaatcctgggaagttaatagcgccaaccacggatagcgttattactgataatgaagtctctaaggaagcaatgaccggtaaagagaagggaaatatcgaaccccctaaagagcaaatagctaatgaagagaaggataatattgaagcctctgaaaaacagatgccaagcattgtgaacgacatggtcgtaacacctgaaaagcaaatgactaataaagagaacgataaggttgtaatctctgaaaaacaaatgccgagtgttgtgaacgaaaatgccgtaacacctgaaaagcaaatgactaataaagagaacgataatattgaaacctctgaaaaacagatgccgagtgttgtgaacgaaaatgccgtaacacctgaaaagcaaatgactaataaagagaaggataatattgaaacctctgaaaaacaaatgccaagcattgtgaacgacatggtcgtaacacctcaagaacaaatggctaataaagagaacgataaggttgtaatctctgaaaaacagatgccaagcattgtgaacgacatggtcgtaacacctcaagaacaaatggctaataaagagaacgataaggttgaaacctctgaaaaacagatgcctgttaatgagaaggacaatgccgtaacacctgaaaagcaaatggctaataaagagaaggaaaatatcgaaacctctaaaaaacagatacctgttaatgagaacaaccaaaatggtacagtcgaagaaaattcaaacactaaaccaacaactgaaaaaacagacaagcaggagacttcaacatttaaaaccgaaactgctaagcaaatcttaccagtaactggtgagaaaggaagtttatggttattgacaagtggtattatcgggcttgcaattgcgttatttacacgtaaacgtaaattataataatcacctaactgatacagttctaaaggatgagaacaagtccagtactgcttctctagattcgcttcaacatctcgcacaacttacagagtgtgacagacttaaaatcaaccacaaagccctcgctaagcttatacatctagcgagggctttatatttattttttataatcttttagttttcggttagtatagccatttcgtttgcttttagtactcgcttcaaaggttctccgaacctttgaaggctggagataagtcgaagcaagtttgcctcaatagctacaggttgctagaacagcctaaaggccgttctaggttggaaatatttcctcgctcgtcaaagtaataaaagataaactaaatgattataatgtttgatagagtgagggggcggagtaataagatatcttatccggctactcccatatttatcacttagttgatttacgtactttgattccgtggttaagaactacctcacggttttccaactcttccttgtgcatgattttggtaagcatgcgcatagcaattgcaccaatatcatatagtggctgattgatagaggtcaggtttggacgggtaaacttagtcactagggaatcatcacttgtgatgatttcaaaatcttccggaaccttgatgcccatatcactgacaccgttcaatagacctgcagcaatctcatcttctgcaacataagctgcagttgctccggcattcaaaatacgttctgctagagcgtagccttcctcgtatttatacttggattcaaaaaccaatccttcgttaaactcgattccgttgtccttcaagccttgtttgtagcctgcaaaacgaactttaccgttgatgtcatctacaagcggccctgatacaaaggcaattttcttgttgttcttagctaatagattgactgcatcaacactagcggcagcgtagtcaatattgacgctaggtaattggtgctccaagtccacggtaccagctaaaacaatcggtgtacgtgagcgtgaaaactccgcacgaatcttgtctgtcaaatgatagcccatgaaaatgattccgtccacctgttttgagaatagggtatttaccacattgatttctttctcatcattttcatcactgtttgctaggacgatattgtatttgtacatatcggcaatatcatcaatacctttggccaaggttgcaaaataagcattagcaatatttggaatcacaacccccacagtggtagtcttcttgctggccaatccacgtgcaacagcattcggacgataatccaagcggtcgatgacttctaatacttttttacgagtattttcctttacgtttttattcccatttaccacgcgcgatactgtcgccatggatacacctgcttcgcgggcaacgtcataaatcgttaccgtatcgtcagtgtttaacatacgttatgtactccctttcaatagttctggttctatgaaaattacgctttcactcaagtatagtgtatcactttttgaaaccactttcaagagataaactctatttttttgataatacttgcaatttttttcattttttgaaacaatagtctatataataaacgaaaatttcactttttttaccactacatgctagaaaggtctccactatgtcaaaattacatcatgttaaatcctacttagaagccaacaaaatggacttggccatcttctctgatccagttagcatctattatctgactggctatcatagtgatcctcatgaacgccacatgatgctctttgttatgcctgaccacgactcactactctttctccctgccttggatgtagagcgtgcggttgcgactgttgattttcctgtagccggctatatggactcagaaaatccatggcagattatcaagagcaaattgccacaaaaatctttctcagcaatctgtgcagaatttgataatttgaatttaacccgctaccatggtcttcagtctatctttagccaaccattttcagacattacacctctgattaatactatgaaattgatcaagtctcgtgatgaaattgaaaaaatgctggttgctggagagtttgcagataaggctatgcaggttggtttcaataacatctcactcgatgtaactgaaactgatattattgctcagattgaatttgaaatgaaaaagcaaggcatctcaaaaatgagctttgagaccatggtcttaacaggtgacaatgccgcaaatccacatggtattccctcaacaaacaaaatcgagaataacgctctgctattgttcgacctaggcgtggaagctttgggctatacgtctgatatgacacggactgtcgctgtcggtaaacccgatcagtttaaaaaagatatttacaacttgactctggaggctcacatggcagctgtcaatatgattaagcctggtgtgactgctggcgagattgactatgccgctcgctctgtgattgaaaaagcaggttatggcgagtacttcaaccaccgactcggtcacggtttgggaatgagtgtccatgaattcccatcgattatggaaggcaatgatttggtcatcgaagaaggtatgtgtttctctgtcgaaccaggtatttacatccctggaaaagttggtgttcgtatcgaggattgtggttacgttaccaaaaatggctttgaagtctttacaaaaacaccaaaagaattactgtattttgaaggataaaaaatagcctcctacaaatctgtaggaggttgtttattctagaaatttctgccgtttttaccgtaaccgtatttttccataaagtcttgacggaattccaaaaggttgtcatccatgattgcttgacggacatttttcatcaaattaatcaagaagtagaggttgtgataacttgtcaaacgaataccaaacgtctcgtcggccttaagtaaatggcggagatacgcacgtgtatagtttttacatgtgtagcaatcgcactctggatctaacggtgtaaagtcctcagcgaactgggcatttttcactacaagacgtccacgattggtcatacaggttccattacgcgcaatacgtgttggtaatacacagtcaaacatatcaaccccacgaattacgccatcaatcaagctatctggtgctccaacacccatgagatagcgtggtttattctccggtaaaagaggggtcgtgaagtccagtacagcattcatttcatcatgtgtttcaccaacagccaatcctccaatagagtatcctggaaaatccatgctaaccaaatcatgggctgattggcgacgaagatcttcaaaaccagcaccttggacaataccaaataaaccttggtcatgcggacggcggtgagccttgagaccacgttctgcccaacgacttgttctttcgatggatttttttacatagtcataaggctggtagaactgcggacactcatcaaagctcatcataatatccgaaccaagattattctgaattgagatagctttttcaggtgacaagaacattttactaccattgagatggtttttgaaggtcacaccttcttctgagatattgcgactatccgccaaagaataaacctggaaaccacctgagtcagtcaaaatcggttgatcccaattcataaatttatgcaaaccacctgcacgcgccaccaattcgtcacctggacgaagccacaaatgataggtattagataggataattcctgaacccatcgctttcaattcttcaggcgacatggtttttaccgttgcctgagttccaactggcataaacatgggggttggaaaggtcccgtgtggggtaatgatttcgcccaaacgtgcacctgtgtgcttttctttcttaatcaagcgatacttgattggaacatctgtcatgttttatttacctcccgctaggaaaaacagtcctaggatattagttctggattcacagttcagctctttcataccatccataaaagcactttacctggaaatacagtttctcaatcttgcatggtctaatctatcagaatgtctttaatgttctcgcttatttcagtgatatttgccttttcttctacttatttaatagtaaatagataggcgcatcacaacaaactgacaaattcccacagcaccttctagtctatcaaaaaaagcctagcttgtcatctagaattatgttacaatgttgggtaaggaggttatgtagatgtttacaatttctaatatacgtgagcgggctcgccaaacgctaaacgagacacctggtatctatcaagtggccgtcatccccgtcactatttctgttatcgttcagttaatttctttctctcgcaatagccttgctggagtgtcggctgaggaacttgctagtccgagctactttatttctacctctttgtttccagtattttacggattgctactaggaatgttgtcattatcagtcatatggactatcttcaatatcatcaaagggggcaaaactaccacatcattcaaagattccttgagcattttcaatcataaagatttctggaaaatctttcgaacttacattttaaaaagtttcttgctcttcctttggggactactgttttaccttggtatcggtctacttatcggtgctggaacgatgattacgattatagctgcatccagtcaatccttagaccctgatgcacttcctatggaaatccttgccatactagggctaatggccatgggaggtatcctacttatggttttaggaattgctctttatattccacaaatctatgcttactcacaggtagaatatatcttgtttgaacaattggaacgcgaagaatatacaggtgccttttcaatcattaaatctagtcgaaagttgatgaaaggttacaagtttaaacgctttacacttgatttatccttcatcggctggttccttcttgtcattattacatttggcctggctggtttatatgtatggccgtatcactatgctgcacaaatgcacttccatgaagaaattttagatgatcaggctaagaaaatgagttacgtataaaataagagcgatatttgctcttatttttatatacgcttttatgtctatatttaagaaaaaaaatatagtaataattggtacaaacatttggattgtgttatactatgactgaggagcgacaaaggactattttagcctgcttggtattggagcagatttcttcctttctattttttacgccatgtgtagtaatttattccaattctaagtgctcctccttagagtcatccggcagttcaatggttcattgagctgctttttcgatgaaaaaagtcggataaatatacccgacttattagtattgttctttcatttcaagatattcaatcttgatacatttattcatgacaatatcgttacgacctgcctgacgcaattgtttttctgcttcttggctttctaaaccgagttgagcccagaaaactttggcgttcgactggataaattcctgtgctacctctggtaaaaattcacttctgcggaaaacatctacaatatcaataggttggtcaatctctgctagactactatagaccaactcgcctaaaatagtcccaccagcagccttgggattaactggaataattttatagcccgcttcctgcatgagcttggaaacgcggtaggctgccgtctcttctcgactagacaaaccgaccactgcaatggtcttagcatttttcagatagtcaaagataatgtcctgactaggattttggaaggaataagacatagagacctcctttaatgtatattaaatgttagaatcaataaaagcttaatgaataaggtgtgctataacacaatcttgtcagttttaactcgttactgattatagcttgtctaccttgattattttttagcaatttggtacacaacatccttaacttggccgataacctttttaagattggtacgctttttatcatctcctggatctaaggaataatagattgaacccacaaccacggagtcatcataagcagctgttgattccatccgataaaaagtcagacgagctaatttttgatctgttaataactgtcgcccaacctgccattcctgaccattgattgtgacaaccgtcttttcactgaaagaatgatttgtttcaaccatccgtgcttctaattcctccggcgtcatattgcgaccgtcttccaatggagactgattaaaagcattgatattatagatttgaaccatgtaattgcttcccccctctttaacatcgtagactgcagcgaccgtctcatccttagtattttctgcattaattgtccaagtagatggcacatcataataacggaaatattccttgatattcccattttcatctttttcagcaacaccattattggccgcataaatcttgtggcctttttgtgtttcgtcggcaggtggtgtactattaacagctacaacctctgcatttgctaaaacattgaactgttcgttcgtagtatcctgtttttcttgcaaaatcggtaaggtggttgaaaactcttcccctgaagaagctggtgttttctcagtcttctgcgatgcttttccgcaacctgcaagtagaagactacatagaccaatacaaagaattaattttttcatactttttcctttcttactttgcttcataccatgttgaaccttcattttcatccgcaatcaatggtacagacaggctaatcgccgattccatagtctcttttaccatggcttttaccgtttctagctctgccactgggacttccaaaacaatctcatcgtgtacttgcaataacatacgtgtcgcaagacctgcttcagtcaaagccttgtcgagattaatcatggctactttgagaatatctgcggccgaaccttgaattggtgagttgatggctgttcgttccgcaaaattacggacattgaaattgcgagagtttatatctggtaattcacgacggcgtttgtaaatcgtctctacataccccttatcacgtgcctcacgaacaatggtttccatgtaattcttaattcctgggaagcgttcaaaataggtatcgatataggctttagcttccttacgtgtaatccccaagttattagataaaccgaaatctgaaataccatagacgacaccgaagtttacagccttggcattccgacggtcatttggtgtcacatactcagctttttcgataccgaagacccgcatagctgtcgaagtgtgaatatctgcaccttgctggaaggcctcaatcaaatgctggtcctgagaaatatgagccaagacgcgcaattcaatctgtgaatagtccgatgccaaaaggacactattttcaagcgatggcacaaatgccttacgaatcaagcgcccttgttctagacgaacaggaatattttgcaagttagggtccgttgaagatagacgacctgtttgtgtcaaatcctgtacatagcgggtatggatcttaccatcttctaaaatggcatcctgcaagccgactacataagttgattgaagcttggtaatctgacggtattccaagatttttgaaacaactggtgcaattggcgctaatcgttctaagacatctactgctgttgaatagcctgtcttggttttcttggtatattccaatggtagtcccatatcttcaaagagaatggtcccaagctgcttaggcgaattgatattaaattcctgaccagctagttcatagatttccttggtcaactggtcaatcaaaacttcgttttcagattgcatagctttgagagtctcagcttccactttaataccagcaatttccatcttagctaaaacatttgctagtggcaactccatgtcaaacaaaagatctaattgctgattttcttctaatttggtcaacatcggctcttctgtctcaatcaaaacctgaaccttacgtgccaagtgtgggaaaaagatctcgcgttctggcaagtctaacttagcacccttgccataaactgcctcatctggaacaagactggtctgaccatagaggttggcaatggttgttagggaattgtcctcaacggtggaaagcaagtatttggctagacggctatcgaaagtagctggaggtagcttaatctcttttcggtcgagaagaacttttccacgcttaaagtcataggtttttatggtttggctttctaaaaagtcacgcaagactggactatcaagtagctcaggccctccgacatagattttctccttatctccccaagctaaaccaaccaaatcctctcggtgataattttcacccaagatttcaaaatagaaaaactggtcttgtttgagcatagcggggctgatttccgttacgatttggaaatcgagcaccgcttcctcttgcgagctggtcgtacctaactgagcccttaattgtttgaagcccatgtcatcataaaattgtcccagttcatccaccttggggccttgataaacaatgtcatccagaccaatttcgattggtgcctgagtatcaatggtagcaagtgtacgagataggaaggccttctccttatcagcaatcaggttttctttcatcttagaagccttcatgctgtcaatgttttcgtagataccatccaaagaaccaaattctgtcaggagttttagacctgttttttcaccgattttggtcacgccaggaatgttatcggacttatctcccatcaaagccttgaggtcaataaactgagtagggctaatccccattttttccatgaggtaggctggggtaaattcttcgaattcggcaacgcctttcttggaaatttcgactacggtgttctcatcagtcagctggatcaaatccttatcaccgctaacaatggtcacatcgaaagggatgtctgtccgctctgccattttgtccaaggtaccgataatatcgtctgcctcatactgatccagttcgtaatgcttgactcccatggcatccaacatctgacggataaaaggaaactgctcacggaattcgtctggagtcttggcacgacctgccttatagtctgcatacatctccgtacggaaagtggtctttccagcatcaaaagccacaagaatgtgggtcggctcaatccgcttcatcatgtggtccagcatgagattgaagccgtaaatggcgttggtatgcagaccgttggcattcttgaagcggtcgatttggttatagagtgcaaagaaggcacggaaggctacagaagagccatcgattaataataatttattttttttcatgtctctattatagcatggatgggggagttttgtggaacttagagagctggaataacagaaaatcccagtcagtgactaggatttttcttttcgataataaatgttctttgcgactactaaactatgtggcttttcaaattcttgatccagataagattggtaggttccgggtgcgataaatccatgcataccaagtatatcggttccagcttgtccaatcacagaatcagccagaagaacgcaattagtagataggacgaaataggttttaaatttagactttctaaatttgaataattccgcatgtattgcctctttcattcgataggcatacatttcaatcggctgcccatctaccgttttcgatactttttcaggacttggattccaaggaagaagcagattatcaatttcagccaatcgagtttctattgcctcttcttgctctggtcttaagctcagctggtaacctaacatggtcattccttcttgattacagaagtcaatataggcttggcgctctgctttgaacaagactccatcaccaatcgcaccacccaaacgctcagacaggacatcgtatgaaccataaccatacactcgtcccttatagctcaaatcaacatgtccaacagccccaaaaccctcttcacctacatgcacaaagacttctaatgctggaagctccgcaatttctttgtggcggttatagatagattgagccgtttgtccctcattatccgccaagtaatcattgactttttgcagggtcatacgaggaatcaaagctgctaaaaataaaggtagaggcaaacggacatggcgcttaagattttgttgctcaatcgcctcctcaaacaagaaaccatcacgcagattagttagtccatacaagatcagataacctccgatgacaattgtttgaacaaccagctgtgtgcctgacacaaatagggaagctgaacctagtaagaataaccaaattccatctattaaatagcgaatccgtggctgtaccccatcttttcgatataggtaaaaagtaatgaaattgataagagctgtaaaaagttgataaatcccaacaaaaatagccgcgaaatagaggggaatttgaacagctaaatcgagactggctaggatcccgaaaagaacagccttcccaactagcgcaataacactttcacttgatttcttctttctgaaaaatgtcatgctcaattcatataaagctaaaaagaatagacctgcgtgaacaaatcgaagaatcagtcctggaaattgccaaccagcaattaaaaatccaataccgatgaagactaagattagaccttctccaactaattttcgacctgttaatcctaaatcacttatttttttcatgagatgattatagcacacttctagacttgtgtttacagaaaaatcctagatgcactaggatttttttgctttatagctgtgtttctcatatttcaaattagttcacaatacagactatccgctttcgtgtttttaggctcgggttaaaacagtctattcccagactgttttaatcaaccgacttcaaggccaccagcatatcaacctttctcagatggtgattgacataccaaccaagaacagacaaaattccactaatggctaagataggaatgagatagacttctagtccgacagatggattgaagcggatactgtccgaaccaatcatggcaagaaggagcttgtggagataaataccgccaaccagtccaaccaacataccaatcagcgaaagggcaatggtttcacgatagatgtacatggtcacctctctattgtggaagcccagcaccttgatggtggataattcacgaatccgttcggacatattgataattgtaaggttgtaaagaataaccaagccgagcaagatggataggatgactagaatggtcatgatggtctgaagcgagcctgcaatcgtggtaagcatgtctataagagaagtattttgaaccaaacttctgactgctggcatcgctaggagttgacttgcaagagtctgaatatgccccaactgactgtctttcaattgaaccaaataggcattggcagtcttctgcttgccggtcacttgttcgtagtagctatctgtcatgtagataaaatgccctgcgtacatatcagccacagcctctaccctgactgaaacttccttatcttccaaggtcagtgataacttatcaccaactgagaccccgtaaatttgcgccaatttttctgtgaggacaatccccctgtcactcagtttaataggctgacctgtcgagctttccagactgacttgatttccaaaatccctacggtctgaaatgtagagactaatcgataaattctttctctgaccgttttcttccaccgtttgattgagctgttcaaaagccactggcaaggattggcgaacctgatctgactgaagaaaatgtgttaacttatctaactcttcctcagtagctctgctattttccaccaccaacatatcataatggatcagctccccaaactgtcgttggacaactcctgagatggaggaacggatacccagtcctccaaaaagaagggcgacggtccctgctactccaaagatggtcataagcatacgaagcttgtagcggaagatattgcgggctgtcaccttatgggtaaagctcagacgagaccagatagccggccatttttcaagccaaatgctggagcctgtgaccggtggcttaggtaaaagtagctgagcaggtttttctgtcagctcccgacgagccaccaagtaagctggcaggaccgaggaaaccaaagataggagcaaggctaaacctgtccaaaggggataaaaatgaagtttagctggtccaatcacagttgtctgcgtaataatgtcggaaataagtggagacaagaggagattacctgctattatgccgactattgttcctaccagacctgccgccaaaccatagagaatgaacttagccataatctgtctattcgtataaccaagggccttgaggatacctgactgtgttcgctcttcatcgacaaaacgggccatggtggtaaaagtcactagagctgcgacaaggtagagaacaactgggaagacattgcccactgcagcaatagacctagtcgcattgctataggtagtatagccatctccacctggtaggcttgaacgagtatagacctgatagggcgcttttgccagcttacttaagtcggatttagcctgagcaatctcggtttgagcttggctaatttcttgatcggccacagctttcttatcagaaaattgggattgagcttgacttaactctttatcagcctcctccaaacggagttcttcctgacggagcagttgatttgaagactctaactgactcagtccccattcatagtcttctactcctttattgtaggctgcaatgccttgttcatactgactcaaacctgcttgataacgggccaaacctgcctgatattcttgattccaagtttggtactgggctagattgctattgtattcattttgtttggtttgatagtaatcataaccttgtaaataggcttggttggcctgctcatgtgcagattccatttggtctaatcggcttttctcaacatccaaaccttcctgtctggccaacaagtcaggatagtctgagagggtttgaccttcttgcaagtgattggcaatttcaaggtctaactcttgctgagcttgaaaccaactagctcgccctgtggaaatctgagatgcggtctgactcagttgggcattttgggaatccaattcttgcttggcctcttctaactgctgggctgacatttctaattccatctgatagccgtctagaaatgaagcagtctgttctaattgagccttacgcccgtccaattcctttttactttcttccaattcaaacttattttttaatagttgggcttgggcagctcgtaattcagcttccgtttggacaaccttagccctaccacgcgcaaactcactgcgacctgtcgctaattgctcctcccctgtttccagttctgactctgcctgttcaagctgggactgagcctgagcaatttcctcttccccttttgaaatatctgtctgtccatctgactgaatagttgccaatcgttgttcatcattgttagccaataacttttctaagtcttcttggtgctggtccaacctgtcttgataggcctgactgtaatatggtaaatcaaccaaatcatcatagcgaatacgggcaatagtgtaaacttctgatttgaaggtatcctgactaacaaggccatagccacctaactgcccatcaccacttacagccatgcccatggtttcattgtcccaaatttctgctgatgcgacaaagcccacaagagtaaaacttgtctgtgtcaagatttttccatccttatcagactccgtcacttgaacagtatcgtccaatttgtaacgatttttgaaagaagctgatagggctatttgccccttttggctgggcacttccccttctactagtttataggtcgatagggtcttgggagctgaaaacagccgaattgcagtctgaccttcattagtaaccacatctttaaagtagcccgcttcaagagtagcaccttctatcgtttctaattcgtcaaggtcagcttgactaagtcccagacctgaaattactgccaaatccatcgttcgatgactggctatgtaggcttgggccgtcttttccatattgggagctgttactttcagacctgtcaaagctagagctcctagcatcatcaggctaaatatggacaaaaaacgccccttggaagaaagcagagattgtctcatatccttccagtagattttctttttcatagtttcacccactaatattctaggcttgcaatatcctgtggttctgcgtgtaactcaacggagtgcacacgggcatcccgcatccgaatgaccctgtctgcaataggggctagggaactattgtgggtcacgataatcaccgttgccccctgcttgcgggacatatcttgtaggatttgtaaaacctgcttacctgtttggtagtccagagcgccagttggttcatcgcaaagcaaaattttaggctttttggcaacagcacgggcaatggccacacgttgttgttcaccgcctgaaagctgagcagggaaattattgattcggtgaccgagtccgacctgttccaagacctcctcggcatccaaggcatccttgacgatttctgctgccagttccacattttccttggcggtcagattggcaaccaagttataaaattgaaatacaaaacctacatcatctctacgataattggtcagttcatgacttgacagcttggcgatatccacaccgtcaatccaaacctccccctcgtcgttgctgtccatgccacctaagatattgagcagagtggatttgcccgcaccagatgaacccagaatgatgaccagctcaccctgctcaatctcaaaggacacaccatcattggccacaatggtcgcatctcccatttggtagtattttgacgaattctttacttggatataggacatgatacacctcgcttcttctcttcctaaaaactgtattcttactacttattatagcacaaaagagggttttcaccctctccttcatcttttacacttgggcaatagcagagccgccatagagtttgagttcttctctgatcgtttcgtagtaatatcggtcaaatgcccgccaagcctgcctgctggtttcactcaatcgcaggtcgcccagtccaaccaaaaaactggtcgaacgataaaatttctcaatcgcaatcagttctgtattggtaaccgacttggcctccgacaatatgcgtgtcgtctctgtcagattatgttggaaccgttgttcatcagctgttcctactttatctgcttgaaaggcccgattcaagtcttgaatgagggccaaaacgtcttgaataatctgtgtcttttccataaaagaccctccttgtttttgataaatttagtatatcaaattagacaaaaatattccatcaaaaaacgatgcctgttccggcaccgttatatctttatttaacagcctccaaagccgcatcatagtctggatgttcgttgacattatccaagtattctacgtaggtgatttcattgtcggcattgaggacaaagaccgcacgcgccagcaaattccactcccgcatgagcacaccgtaggatttaccaaaggcatggtcatagtaatcagacagggtgatggcatcttccaaacctgcagcgccacaccagcgtttttgggcaaaggggaggtctgctgaaaccgtaataacaaccgtattgtcacggtcagccagttcctgattgaagcgacgggtctgggtatcacaaatccctgtatcaatagaaggcacaacactgatgaccttggtctgcttgccaaagtctttcaggcttttcaagctcaagtcattggccatgaggacaaaatcaggggctacatcccccactcttaattgcggacctaccaaggtcaccggttttccaataaaggttgtcataaacatctcccttgcacttaatatatacattgtaagcgtttatgtaaaaaaataccagttttttgactggtatttttgatatagtttgtaggttttcaatcgcagagcgttcaagacgacggacactgagctgagggccatggctgcacctgcaaacataggattgagcaggggtccaccaaatgcatgtaacagacccatggcgattggaatacctatcacattataagcaaaggcccagaagagattttgtttgatggtccgcatggttgcctggctgagtttgacagccttgaccacatccaaaatgtcactatgcatgaggacaatgtcggcagactcaatggcaatatcagtccctgaaccaatggctagacccacatgtgcttgagctagagctggggcatcgttgatgccatcccccaccatagcgactgtcttgccctgttcttgtaagaacttgacttggttagccttgtcatctggtaggacctgactgatcacctgttcaatgccgacttccttggcaatggctttggcagttttttcattatctcctgtcagcatgacaacctctagtcctatggtttgcagagcctggacagcctgacggctggtctcttttattttatcagcaatggcaatgactgctagtacttcttgctggctggctaggaaaacaggcgtcttggcttgctgggcaaatgcctccgcaactgcacgtcctttggaaacatcaattccctgttcccgcatcaaccgttcatttcccagatagatggtctgctctgctattatcaccgaaagaccacgaccagaaagtgcctgaaaatctgtggcgggcaagagttcaatcttttctgtctgagctgcttgcaggagagcctgagccaagggatgttcggaaaattgttcgctacttgctgctagctggagaacttgctcacgatttttagtagacaagaggtggatgtctgtcacctggggtttgccctcagtaatggtcccagtcttgtcaaagacaatggtattcacaccttgtagggtttcaatagcttgaccagacttgaacagaaggccattttctgcaccttttccagtaccaaccatgatggcagtcggcgttgctaagcccagagcacaagggcaggcgatgaccaagacggcgatgataatacttagtgaaaaaatccatgattcttgacccaagaagtaccaggccagacccgacaagagagccaagcccatgacgactggtacaaatattgcagatacttggtcagccaatttggcgatgggggccttagaaccttgagcctcttctaccaagcgaataatctgggccagagtcgtatcacgaccaaccttggtagcctgcatggtaatggcgccttgctggttaagggtgccgccaaaaacattattgcctagagctttcttcactggtaggctctcacccgtcagcatagactcatccacacgtgtctggccttcgagaacctgaccatcaacaggaatctgttgcccaggacgaacaataacctggtcaccgaccaccacttcttcaatcggcacttgcatttcctgaccatttcgcaagacctgagccgccttgggggccagatccatcaatttcttaatcgcctcagaagtctgacctttggctctagcttcaaaatattttcctagggtaatcaatgtcaagataacggcggctgattcaaaatacagttctggatggtgaccgtgcatggccacttctttccccatctgaagaaacacaatcatcaaaagaccttgaaccaaggctgcccctgtcccaacagcaatcaaggaatccatattgggatggccttgcaagagagttttaaagcctttttggaaaaaactgcgtccgatatagaggatagggatgagcaagataacttggctgatcgcatagactagcggttggtggagcaaagctggtaacggaagccctccccaaggcaacataggacccatagcaatatagagcagtggaaaagtaaatgctgctgaccagacaaatcgatgcctcagcttttcttccgtgctcggtcccttgtccgcagccccttctactttttctggtctaatcaactgataacctgcctgctcaactgctctttcaagactagctggattttgcctatgacggctataacggatagtcgccttttctgttgctagattgacactgacttcttctacaccctctagtttgcccagagctttttcaaccgtcagagcacaggaagcacaggtcatgcctgaaatgtcataagactcggtcaccaagttatcgactagctggtaccccgccttttcaactgcctgacgaatatcctctagtcccaaaagcttttcatcatagctgacactcaatttttcagtcgctaggttgacactgacttcttccattcctgctagtttaccaaccgctttctcaaccgtcagagcacaggaagcgcaggtcataccttgaatgggatagcttgcttgtttcataggttactccttttccgactacatctgtaaacaaattatacaatatacgactacgtttgtaaacatttttgattaatactcttcgaaaatcaaaatcagacgttgttgacttgatttgatgactgaaaagctcctgtggaggttttcagcctgttcccttgaaatataaaaggaacagtgttctatctacatcatatcgatacgaactaggttcgctctatctccaacctccaaaggttccccaaacctttggagcaagtctgtttttgattttcattgagtataaaaaatagattggagagaccccaacctatttcttactagctctatttattctttactggatttttttcgatgaagaaaaattgctgttaaaattcctgcaacacctagcgccaccaacaagaggctgacttgctcacctgtactaggaagacttgatttaccttttttattggtaggtgttactttcttatcagaaggcactactgttcggcttgatgaggaagtatccgtagctcctcctgtgttagaatcacttgtagactgacttgtactggttgaagtttcggtaccacttgatgatggctcagtgctggtcgatggttcagtactacttgatgacggagttgttgctgcttcaatttttgccatcatttcagcttcaacagcttttagttgggcaaaaatctctgctgaacgagccaaggttgcctctgttacagttggagccagagctacggctgcatcttctgaaagtccggcatattgagcatcaagagctgcctgtgaagcaatccattctttttcaagtgcaatccatttttcttgaattgatgtaccaaataactctgggtgtgagatggccatcttatcaatattttgtaccgtccagtaccatgaattggtatcataagaagctgagcgatttttaaaggcttcataagtatcagtcacaataccataaaatggaacatacggtgtattccttgtctgagccaagcccaaccatactgtgccaccgaaggctgatggtaagctactattaatctgataaacatgggcatcgatgacgttttcattaccaagagcgtatttataagtcgcatctgccgcttggtcattcgcaccattatccccttgttttaccttacctgcttcatcgtctggacgaaattctggaagatgttcaaaacggttacgttgtaaggcaaaggtatcttgtaaactaaagcgacgacttgggtctgttggctgacgtagcaaatcatacacagcatcttcataggttacagacgatgctggatctaacaattttataccagcgtatgtccgagaacgatcaccatcagcataattctcaggtccatatgatttggcaatatggaacttcccatcaaccatcatataattttcagcctgtttggctacttcttcaacctttgcagaagcaatcacattttctgtatcggtaaaatcaacatgacctagatagtaagtatttgcaaaaattgcatacttgtcttctgggaatttgatggctacgtattggtgacctgacaaaatttccatgtaccaaacttcattcttatcagcaataacaatgatattcccttctgccgaacctttttcatcaattgtcttcgcaattaattcgataccttcacgcgcactggtgactctaggaagaacatagtcaatcaaaatggcctcacctagtccccccgcagttaccaatgggtcaacagctaaaacttttttatttggaatagctgtaacagtagcagtcatggacacacctttttcattaaatccatgcgcaccaaaattaccgtttgacccatccccacgtgccgcatcaggcgtagaggtgtacttgaactcatttgccaagtgtggtgctgtgaaaccgaatgattcatccaccaacatatcccccttggcataggctgttgctggaaccacaatataatttttattgtgcgctccattatttggtggatatggataatcttccgttctaccataaaggatagaaccatccgttgtcaaccctttcccaataataaagcctgaacaggcttgaacaagttgaacagggaataggcaaaccaacattagaaatgtggctatacgaacaaaagtctttttcatagacttctcctttcctgatactctgtgaaaatcagaagtaggcgccctccagagatataaactcagagactattttacacaagtctcttatccaaccagaaggtgattttcgtggagtataatatgatttacccatttgcacctacattgtaacgcaaaagcacctgccttgcaagtgctttcaaaaaaatatttatccttttttcctagccagcatggtcgcaaaccgcatcttgaggaaatggccattttcatcccgcttgtgaagttgaccgaaatcttcattgtacttgaccagttcccagtcacggtagtattccttcaactcacctactccaaaagtaaaggagaaattcataggacagggcgcatcttctgtatccatggccgccacaatcaagttatagccaccaggtcgtgtctgctcctgcatattgcggataatagctggcacccgctcccgctccaagaacataaagacaacggttgagataatccagtcgtaatcctgctccagactagctgagttaatatcgtaagtcccagcctgcaagtccaaatcttctacttccttgacctgcaagagtgtccgaatacttggtacatctttatctacagcagttacctcaaacccctgctgggccaagtagagactgttcctgccatgaccacagcccaagtccaagaccttacaaggctcaattctcttcaaggcctccaagacttccgaatgtgtccgagtatagtcatactttttggcaaaatagtcttctggttgacagaaaaattccaagaaaaactccgtatcctctgtcagcaaagtcacccgatgccaagcctgtggctcgacaaagggaacatcatctgtcggaccatagacaaattctcccaaaatttcattatcatctgaaatcggctcaaatttaagttgacctctcaagaccttgattttggcccaagtacctaccttggtattgtgcttggtcaaaaaatgctggggaaccgtatcctgattccaaataggcatgcgtttgtaaggaactaaaacagtcattatctctccttttcgtctacaaaacttaaaacgtgtttctagtctatcacaaagaaatcttgatttcaaatctatattttcacttgacttagagtgaactccaaggtgtataatattccatatcaatcagaaaggacatttattaataaatgtaggtgtgtagaaaatatgaaagcagctatttatgaaaaagccggtaagatgaccgttgcagaaatcgaaaaaccaagccttcaagccaaagatgacgtcattatcaaggtcgttcgggcctgtgtctgtgggtcggacctttggggctacggagaagacattcaccatgaccacggtgacacaaactctggtcatgaagccatcggtatcgttgaagaggtaggcgaagacattacaacacttgttcctggtgacttcgttatcgttccatttacacatggttgcggacactgtgatgcctgtcgtgctggctttgacggtacttgtgacaaccatccaggctacaccaactggggcaacaactaccagtctcaatatattcgtttccactacggtaactgggccttggtcaaaattcctggtcagccaagcgactactcagaaggcatgatcaaatctctcttgactctggcagatgttatgccaacaggctaccatgctacgcgtgttgcagatgtcaaacctggtgataaggtggttgtcatcggtgatggtgcagtggggcaatgtgccgtcattgctgcaaaaatgcggggagcttcgcagattatcatgatgagccgtcatgctgaccgtcagcaaatggctctggaatcaggggctactgctgttgttgctgaacggggcgaggaaggaattgccaaagtccgtgaaattcttggaggtggcgctgatgctgccctcgaatgtgtcggaacagaagcttctattgaccaagccctcggcgtccttcataatggcggtcgcatcggttttgttggtgtgcctcattacaacaaccacgccctcggatcaacttttgctcaaaatatcattatcggtggtggctctgcttctgtcacaacctatgataaggaaattttgcttgatgctgttctcaaaggcgacatcaacccaggtcgagttttcacccaaacttacagcctggacaatatcgaccaagcctacaaagacatggccaaccggaaaacgattaaagctatgattacggtggattaagataaataataagccccagatagtctcgaaactgtctggggtatttgttttcctataacaaaaaagaccgggatttctcccagcctctatcgactattgatagccttcatggttcgtttgatatcacggtcttgctcacggcgtttaattgactcccgcttgtcgtagtcgtgcttccctttggcaagcccaatcaaaaccttggcaaagccatccttgatatagaccttgaggggcaccagagtcatccctgttcccttgacctcattgtccaaagactcgatttgcttcttccgcaagaggagcttgcgggtccgtgttggctcctgattccagatattgccctcatcgtagggagcgatatggacattgaccaaccaagcctcgccctgcttgatctgggcaaagccgtccttaaggttgatccgccccgcacgaatagacttaatctccgtccccgtcaggaccatccccgcctccactgtatcgacaatggtatagtcgtggcgggcttttttattttgcgcaatcacattgccctcacccttggccatgcctatctccttttcttcttgttctttttagccacttctttgtaaaatggtttctttttcttgtcttttttgccactttttgacttgtggtcttttccagacttgtgacgtccgctgtcgcgaccagcagcttcttgtttgtagtgcttgccccgtcctcgccctgaccgatcatcacggtcacggttggagtgactagcagttctccgcttggctttcaaagctttttcgacaatatccagttcggacggcatgtgggcaaaatcgatttcccctgtcatcttgtccgcccgcgttagcttgatacggattggctgaccgacacggaagacacgacctgatttctcaccctgcaaggtcagagttcgctcgtggaactggtagtactcgttgaggttggtaacatggatcagtccttcaacggtgtttggcaactcaacaaagagaccaaacttgactacgctagatacgacaccatcaaactcttgcccaacaaattcttgcatgaattctgccttcttcatagcttcaacttcccgctctgcatcgatggcacggcgttctagactggatgaagacttggcaagctcaggaatgacctgctcaaaatgctctgctttttccgaaggattgtgaccatattcccgcaccatacggtgaaccagcaggtcgggataacggcggataggactggtgaagtgggtgtagaactccgcacccagtccgtaatggccgtggttgtgctctgagtaacgcgcctgttgcatggaacgtagcaacatcatgttgaggacgtccgcatagggttcatccttgacccgctccatgagatcctgaagggcgtcctggctgatagagctggctgtaccatataccgtcagaccaaagctagtcgcatagtcgatgaacttctgcaacttgtctgatttaggctcctcgtggatccgatagataaaaggcaagtccaacttagcaaaatgctcggcaacgcactcgttggcagctagcatgaaggactcaatcatccgctcggcaatgcctcgctggcgcagttgaatatcgactggcagaccatccttgttgacgatgattttagcttcagctgtatcaaagttgagagccccacgcttgtagcgcatggtttccagggtttcatggagtttgaccatgagctcaacacttggcacgattgtcttgtatttgtccagcttttccttgttacctgcaatcatgtcattgacatcggaataggtcatacggaaggtggttttgataaccgtttggccaatccagtgcttgaccaccttgcccttgcagtcaatttccataatagccgactgggtcaggcgatccacatttggattgagggaacaaatgccgtttgacaaacgttctggcagcattggcaccacacggtcggtcacatagacagaggttccccgcttgacagcttcctggtccaaggctgagccctcagtcacatagtagctgacatcagcgatatggacacccagttccagattgccattcttgagctgcttgatatggaccgcatcatccaagtccttggcatctgcaccgtcgatagtaaagatgatctcatctcgcaggtccaagcgtccttcaaagtccttctcagacggactttctggtacccgattggcctccgccaaaacttcgtcagggaattccgacacgatatccatggattccaaaacttccaagacatcgatccctacatcatccttatgccccaccacgtcccgaatggtcgcaacaaagtggtcccgtttcttgtttggataggcttcaatgtcaactttgaggatttccgttccggtcaataccagaggtgacttcttaatgtaaatcttctgagcgattttctggtttttagacttgatgtagcctgcatactctggcttgtcttcgtcaaagacaatcaagcccaccgctgttttcaggctatgttccaaaatatcaatgacttccgcttccgcagccgtccccttgaacctgtccgccactttcttgatagccacttccactcggtcgccctcgatagcgaagttgacatcgtcacggctgacaaagagatcatcttcctcttcatcaatggtcacaaagccaaaacctgacttgtgagcacggaaaatcccctgtaaggttaccttgttcttagagatttttggagcaggaagagtaatccgcccagcattatcaaagacaagttgacgactgccttccatgctagaaaccagcttgaccaagtctgtaaagctcttagcagaactggctccaaactgatctgccagctggtccatggtcacaggaccaacttctttaatatagtttataatttcgtttttcatcttgtatttaccagagtgctagttaagaatctagcactatttctctttcagtcctttagtttatcttttattactgcgacgtacgaggaaactccgtttccctatttccaacttcaaataatttcatcattatttgaactcgctttgtcgtacttcagtacagtctgcagctcgttgcctagtactaaaagcaaactaaaagactgtattttgcgttatatccagacgcagtggttgattgctccaacaatcaaatgattgttggaggtgggagataggatttgcaaagcaaatctcaatagttcgcgaataacgctccgaaccatacctattcaacttatgcggaggtgggcagacgaactctttatacttgtcgagttctggcccactcccaaaaaaatagaccaagaacaagtcccagtctgatttatctacttacttgaaatgataacaagtgccagcgcatccaacatccataggaaaatcagaatagccgtaatacgttgcatcaccgcttcaaaaccacgggcctttgtacgttcaaataaggctccactagaagagtcaaagacgttgctagactggttttttgctggctgaataaaaatcactacaatcaaaataacagataaaatcaacagaattgctaataatgcttgatacatatttttttcactttctacaataacttatgacattataccataaaacctacttagtttcaaggtggagggttacttttctctcttttgggcagtatttaaggacttcaatcttatctggatgagtcttggcgtttttgctagtcaagtagttcttactaccacattctgaacattgtaaattgattttaactctcactaaacatcccttactttcaaatagtttctaaaattggtcaaagaccagataaggttaaagaggacaagtccgctcgacagatagaaaacccagtcataacccatgtgagcagctaccgcagaccccatcatgggaccaacaacagaacctagattattaaagagttggttgtaggaaaatatccttgaaattccttcttttggtgtcaacttggtcaaaagagaattgaccgaaggcaacagtgctcctgtcccaaaaccatacatgaatcgcaacaaaccaagctggaaaggattttctgcaaaaacacagaaaacattaatcaacagactgtaagtcaaagcaattaatagaagtcgatggttgccaatacgatcaccaattttccctaaataaccggatgtcactagcgatgccataccaggcaaggaaatgataaaaccagcaacaaataacagattatctgtctgtcccaaatgccgcacatagagggtcaatataggaacaacagcctgagcagctgcaataataatcatagaagtcacaaaaagcccaaccagcatctgccgatctttcacctgctcaaatacctctttaaccgacatctcttcgccttttttgactggaacaaaatcctctcgaatatagaaaacggtcagtaacacaacgatagcataaagaagtcccaccagcaaaaataccatatgtacgccaaacatctctgctaagataccacctagggtcggaccaatcaaattacctgctaccgcacctgttgataaggtccccagagcataccccgtcttatcctttggaacctgactggcaatcaaggcagtcgcattgggaatgtaccctgtaaataccccgtttaggacacgtaaggtaagcaaccaaaaaacatttggtacaaaggccataccacccatagtaaaaatcatggcaaaggccgctcgcaccatcatgggcttgcgaccgtaacggtccgccaaactcccccaaataggtgccatcaaggctgccgcaagggcattaacagataccgcaagccccgcataatattctacctgtccaggacctacccccaactcttccacaaaaactgagataaaaggcataaccaaggtaaaactcgtccctgttaggaaatttcccaaccaagccaccttcaaattctgcttccaataactactaccgtcgtccatcctttaattcctccaaaagctgagcaacctgtgctaaggtcgcctcaaccgctccgctattgtcaatcaccacctgggcttgcgaccgtttttcctctaaagaaagctgagcagccagacgattttctgcatcttgaacagctaagccattacgtttcataagacgttccaactgctgtgctctatcgacataaactagccagatttcatttacttccccgctataatctgcctcgtaaagcaaaggaatatccatgaaaagaacttgctccgtctgttttagagcatcccttctgtctaacagctcctgcctgataatttggtcctgcaggtcagacaggcgagcccgcaacttgctatccgcaaaaacagcctgacccagcttgaccctgtctaaatgtccatctgccgacaagatgtctggaccaaactctttcagcaaaatctgatagagcttgccacctttggcctgtaattcgtgaacaaccgcatccgcatcaatgactggataaccttgttctctcagaaaagctgtaactgttgattttccagaggcgattccgcctgttaaaccgataattttagccatgtttcacctgacacttgggacagaaatgtgtcccccgtccgcccagctggattttgacaatctctgtctggcaacggggacaggcctgccctgtctttccgtaaacttgtaaataatcctgcatagtcccatccatgcccaaggcatttttgtaagtccgaatggttgaaccacctttttcaatacccagttgcaggacttcaatggtggcttgacggaggtctgccacctgatctgtcgacagctgattactcgtttgtgcaggatgaactttggccttgaacaagacctcatcgacataaatattgcccaaaccagccaccaaagactggtccaaaagatgcgacttaatgggctttttcgacttagctaactttttggcaaattcttctaagtcaaaatcttcctccgtcggctcaggaccaatttttcgactgataaaataggcatccacatctgccttacccagcagttccatggtcccaaacttgcggacatcttgatagaccaaggtcgagccatctataaaagtaaaaaaggcatggaaatgtttgttggcaggcacctggtcagcaaagaaattgtacttaccttccatccgcaaatgagaaatgaggacatggtctgtcaggtaaatcaagagatacttgccacgacggtccacatctaaaatctcctgaccaatcaagtcttggcagaaggcatccacacctgtcttaatcatgggagcataggtcacctccaccttggaaataacttttcccttgaccaaacgattcaaaccacgacgaaccgtctcaacctcaggcaattcgggcaatttacgataccaagagcgtaaaaagcgactgaaaattaggagagcgacgctgtgtgacttgcacacaaggagctctatctattttccgagcttttagctcgggttcaagtacgcaaacactcatcctttctaacaaaattacaaagcaaatagaaacctgaccgacggtgcttcggcacctaggtcacggttgtgattttcaaagagtcgtaggcgagttcaagacaacgcctaatcggctttcctttcttgtttactaaaaagatttctccataacgcagtaaaagcctttcggcttttctgctaactatttctaagtgattgacttagacagcctatccccaggctatctcgccttccaatttctaagatcgggttttcaaatggtcactttcacattcctatgtgacctgctgaaacagtctattcctagattgtttcactcccccgaactacctcgccctctagttttcaagctcggttttttcaaatggccactttaacatttctatgtgaccagctgaaacagtctattcacagactgtttcactccctcgaacttcctcgctctctagtttccaagctcgggttaaaaacgtcccccggacgtttttaatactctttctcattataaccaaagtcggcgaggtcgagttttttgtctcgccagtttttcttgaccttgacccaggtttcgaggaagaccttgtcacctagcatgagttcaatatcacgacgagccatggagccgattttcttgagcatggctccttgcttaccgatgatgatgcctttctggctatcacgctctaccataatcgtagcgcgaatgtggaccttgtcggtaaattcatcacgtttcatggactcgatgacaacggccacagagtgcggaatttcctcacgagtcaggtgtagaaccttctcccgaatcatctcagataccaagaaacgttctgggtggtcagtgatttggtccgccgggaaatactggaagccttcgtccaggttttccttgagaatttccatgagtcggttgacattgttcccttgggtagcagaaattggcacaatttccttgaagtccatctgttgacggaaatcatcaatctgttccaaaagctggtctgggtggaccttgtcaattttgttaaccactaaaatgactggaaccttggcctgtttaaggcgttccataatcatgtcgtcacccttgcctcgcttttcatcggctggcaccataaagaggaccgtatccacttcacgaagggtgctataggcagattccaccataaagtcacccaaggctgtcttaggcttgtggattcctggtgtgtcaatgaagacaatctgctcttcttctgtcgtataaatgcccataatcttgttacgggtggtttgagccttgtcgctcatgatggcaattttctgccccattacatagttgagaaatgttgatttcccaacatttggacgacctaaaatcgccacaaaacctgacttaaatgtcatgtattctccttatattctaaaaaataaagtcccaaattttcggcacaaagataatcaatcctgtcaacaaggcaaatcctgacacaaacaagactgcccctgctgccatatcttttgcattctttgccaacatagaaaaatgatagtctgacgccaaatccaccacattctcaatagccgaattcacaatttcaaaagcgataactagactaatactgagcaagaggaagagccattctgtcacagatacttggaaaataagtcccgcaagcacaacaaggacagctgaagccaggtgcttcttcatattgcgttcttccttgaaagctgtcaacaaacctgttactgcaaattctagactagcaatcaattctcggtttttccagcgattttttgaattattctcttgtaagtccataggccgtcaaaatttcttcttgtaaaccaaacatttctgcttcttcttctggcgtataatgatcatagccattgatatgcagaaaaccgtgtacagctaaaaagcccatttcgcgctcgtagctatgaccataatcttcagcttgctcacgtgccttatcgatagaaatatacaattcaccaatataggcatcgaaatcttccatcatttcagccaattcaggattgtccagtaagtcttcctcatcaaaaacaatctccgactctggcttatattctaaactgacaacatctgtcggacggtcaattcctcggtactccaagttaacctcatggacacgcttattgtccacaaaggtcacagccatttccttattctgcttgccaattttttcggcagcaaactggagcaattccgtaatctgctcctgcatttgagcagaaacctgccctgtttcatcaatcatttcaatatacataatcttacattccttttacgtttccattatatcataaaacctatcaatgagggttttttagtggtataatgtcctcagaagctatcagaggaatggaaaatgttacaaacaccgaaacacattactgccatcattgagtctcatctggatcagatgactagacttgaaaagcagattgccagttattttactcagttagacccatctagcgccgatcttagccaagaaaacactatacagcaactccacatttctccatctgctcttacccgttttgccaaaaaatgtggattttccggttatcgagaatttgtctttgcctttcagaataaccaacaatacttggataaacattttgaaaaattacagcggagcctaacaaaaaaagtcttggtagactatgaggaaatcctaactgctaccaataaactggtagatgaggaaaaattagaagagattgccaaactgattgacagtagcaagcgtgtctatttttacggaatcggcagttctggtttggttgcaatggaaatcaaatcccgctttatgcgactgggtgtagtctgtgatgcaattactgatgaaaacaatctcatctggactaccaatattctggatgatagttgcctggttatcggtctttctctgtctggtcagacagaagaggtcatggagcatctccagctggctgctcaaaaggggattcctaccgccctgttaacaactaggagttttccccatccgacttttgaccaaatcattcctgtcgcctctgtccgccacctcaattacggcaatcgtatctcaccccaaatccccctgctcatcatgctagatattatctacgcctattttttagctattgacaaggagaaaaaagagaatattttcaagcaaaccattagagaataattcatccgtctttctatttcacaacaatcttaataaaacaaaaagcattcaaaaatacccgataggtacagtttgaatgcttttaattcgcttaaatataactctattcttcaagaccaagaatttgattgatttcttggctatacagaatagccttacctccgaaaatagcctgtattcctccttttacatccaaaacagccgttgcacctatagactgaataactcccttatccacaagaccactatttctgagcgatactcttaatcgagtcgcacaggcagtcacattctcaatattatctgctccaccaagagcatcgatgatagcaattgcattatcacgaagactagaaccgtttgataaaactttttccgaatgtgatgcttggtcactgctttccataccaggaactagcacgtgaaatttggttactaaaaatttgaaaactagataataaactgctgcccaaagcaagccaacaggaatcacgtaaatccaattggttttgtcatttccttggaaaacaccaaaaatcaagtaatcaataagcccaccagaaaatgagttcccaatacgaatttgcaggagatctgcgactaagaatgatagtccatctaaaaatgcgtgaacaacatatagccatggagcaacaaacaagaaagaaaattcgattggttcagtaattcctgtcaatagggaagttaatgcactacttgaataaaaactgcctaccttcttacgattttccttaggaattgcgtgatacatagccaaacaagatgctggtagaccaaaaatcatcgttgcaaatcgaccagcaaaaaatcgagttccataagtaaataagcctgtgtgattcgcatctgctaattgagcaaagaaaatattttgcgcaccttggatcgtctcacctgctaccacttcacttccacctaatgaagtataccaaaacattggatagatggtatggtgcaagccaaatgcacctgtcaaacgcaatccaaaaccatataagaaggttccaaaacttcccatctctgctattgccttaccaaaatcaactaataaattctgaatcggtggccaaattatataaaaaatggagccaatcgcaattgctgcaaatgatgaaataattggaataaaacgagagcccccgaagaaaccaagaaaggctggtaattcaatttttcgatatttattgtgtaaagttgcaacagtgataccaatcgctaaagcgcccaaaactccagtatcaatgcttgctcccttatcagcaaaaagagttaaaaatccactaatagtagccgtataaaccaagtatgcaaccccagcagataggccagcagtccccttatcagcatctgccaaacctacagcaacaccaattgcaaaaatcaatgctaaattcgcaaataccgcactacctgccgtactcatgatagtgaatacagcttgcaaccacgcttgatccaatacaggaaattgtgctacagcattactatttgataaagcgcctccaattcccagtaagagaccagcaacaggcaaaattgagattggcagcataaaggcctgacctagctgagaaaacttcttaaaattcatactccattcctttctataacctatttattatttatgtaaagcactaataaaccgctctgcgatttcctttggacgtgtgatcgcaccgcctacaacaattcctgccacacctaaatcatgaataatttttacttggtcaggatagtgtatttttccttccgctatcacatcgatacctgctcggcacaagcggtcaaccaattcaatatccggtccctcctcctgcctactataggatgtataccccgaaagtgttgtcccaatgaaatcgatgcctgcttcataagcagttaatccttcctcaaaggttgaaatatctgccataaaaagttgttcggggtatttttccttgatttgcttaatgaaatcaacaatatcgagtccgtcataacgctcacgcttggtacaatcaagagcaatgacttcaatatctagagctgctaactcgtctacttctcgcatcgtagccgtaataaagggctcttgtggaggatagtctcgcttgataattccgataattggtaaagtagttacttcttttatctccttaatatctcgtacactattggcccgaataccgacagcccctgcttcttgggcagccttgactagtaaaggcataataccgccttcttccctatacagaggttcgcctggcaaagcctgacaggaaacgataattccatccttaatttgttgctttaaatctgtcttactaatagtgcccattatgtcattcctttctgctccatactagagatagcgcttacattgtttattatatagtatattattattttttcaataacctctttttatttagaatgtaatttcgatttttgtagaaatacaaaaaatcctgaaaatagtttcagaacgagttctcatacctaaaagtagtttttaggaaaatataaaagattctacccaaaatttgaatagaatccttattttaataccattttcttgtgataagtttctgacgaatagtgtttagctcctagcctctgtggctaagagagtataatacattgccagattactctatcacctcatccgcatactgtgggtataacgttgttccccagatggttattttacgttgaccaacaagtggtaaatctttgtcataaactgttctccaccactcccatgctaatcctgtacattcttgaatattgacatgaagattgcgagcatttcctggaatttgaatggtttcactccagtgtgaggtcagatttacaccattcttatcccaagcttttggttcccaaacttcttctccagcttcattgtaagatacttcttcccaagtaatgttgtatttcgcaacataagcacctgaatgatccaatgtcaatgcactgctattatggactgttgaagttgtttctatgtactctgaattgctcaaaatctgagcaggtctattgtctttgacaaagttggttgaatacgaaatcggaacacctggattgagttttccgtatcttgcaccttcttcaataatcttcttcagtgtttcaatatttccgctcacaacagtagccgcgctacctgcatccccaccaaaaatataagcagagaatgaagtatttttcagaatgtcttgatactcagcattgccactaatatcaacgcctttgatggctgctttaaatgcggcttgaacttgggtactcctactgctagtttctaacttgatgaacatagagcgtccataagaaacgctggaaacataaacaggaggtacctcatctgttatcccatttcgtttcaaatcttctacagttgtcccttctgcaaaaagcttgcttggagattctggttcatcaacactaactgtataataaatttgtttaaagttaacaatctgaacctgtttttcacccgaattcacggcatcaaaattgatatctaatggtacagcaattttttcaaaagaggttccgaacttcgttttcaattgtgacatactgtatgccattgtttcatcatattgaagctctgcttgggtattgccatactctccagcatacgtattattccatttagacagaaggttattcacccctgttcgaacagtacttcttgttggagaatttacaacagtgtggctatccccattggccaaaccaggtaaattcaaactaagcgtcagatctccccgcgcaatactgataagcgttggattattatccagaagattttggtcagcacgcaataaagcacctggataaatatttgcagccttagcatcaataacagcaatatctgcactattgttcgtaatattcttcttttctctgcgaagtactacaaaacgtccgttttctaacataccagttgttgctggcggattatcaatgtattctccctcatttgtaagaatctcttgtggctcgtaagtcaagctttgaaaatactgattaatatcttgtttggaatctgcaagaacactcaatggtgtgacccctacgagtgccaaactgactattgagcttaaaatcaagtgcgaactttttctcataagttttatcctttcatgttttcactaatgaaatgaatagacataaaaaatggtattaaaaaaacaaacgtttgcgagttcattctgcacctttttagataagttgtcaagactccttgagatgaaaaacagacaaaaaacagattacgcctctctatttgttgtttttccaacaatttccggaatatttctgtaaacaacctattcattttctgttttttctgaatttctgtcagttttttatacacattatcacttataaatatttgcaatgataaccagatattatagttgtttagttcgcttttagtacaaggcaacgagctgcaggttgctagaacagcctagaggctgttctaggttggaaataagacatgcgaagcaagtcactttcgtggagtacggcaaagcgagttcaaacaatccagtggagtgtttgaagtaggaaataagaaaacggagtttcctcttgcgtcgaagtaattaaagataaactaaatgactatacctcctctttttgaacacaaaaactcccccgactagcttctaatcctattaaaaacttgttaggagagttattccattttatttatccaatcggctttatgatgtttttgataagggaatccagattgaaccattcgtcaatcatataatctgcctgaaaggaactttctggctctgaccgttttctgtgattaaaccagaccgcttgccaaccagctgtttttgccccgatgatgtcattttcaaacgaatcccctagataacaaatatcttcgcctgacatccccaaacgttcttccattagttgaaaaatagcaggatttggctttgtgataccaacttgtccagaaataaggacatgttctagctcaaaccaattaactaaccccatcgtgcgtatctttctcaactgatgtctataaggtccattcgtaataatccccattgcaattccttgcacctgacaccacgaaaatatttctggaaacactggactgagctctatctgcccttgaaaataatcataatctatttgaatagctaaggctgttgcatcagacacctgatacccaaaatctgccaaagcatgtttcatccgataaatatgactgtctttcaaactcatctttccaattgctgtcgcttcaaatacttcatccgcatatctgcgaaaggaaaggtagagtggttcaatttgctcccttgctacttcaatgtgtctttccaaagcacgttcaaacggttgaatctgatcataaagcgtatcatctacatcaaaaattaaggctttcatgagtcaattatagcaaaaaattccagcaaaagcttggaatttttaactgcttattacacctttgcttgaatctcatgcatttgagcatatactccaccacgtgcaaccaattcttcatgcttcccatgttcaataattcgaccttgatctaagacaagaatctggtctgcattttgaatggtagaaagtcggtgagcaataataaaggttgtccgaccttctttcaccacttccatggcatgttggataatttcttccgtctccgtatcaatatgagaagttgcttcatccaatatcagaattttaggatcagagtagagtgtccgcgcaaaggcaatcaattgacgttccccacttgaaaaggccgcccccttctcaacaaccggttcatcaatccctttctctaagcgagatagcataggccctgcaccaactttttctagcgcctgcatgattcttgttctatctgcttcctcttcattcatggaaacattgctggcaatcgtccctgtaaagagatagggatcttgcaaaacaatccccatgtgactgcgcaggctttcacgagaataatcacggatgtttttcccatcaatcagtacacatccctcctgtggatcatagaaacgatagaggagattcataatagaagacttaccagacccagtatgcccaaccagagcaactgtttctcctttttctgctcgaatggtaatatctttcaaaactggtctgttttcttcatagctaaagttcacgtgttcaaacacgacttgcccttgttcaacttccaaaatacgatcacagtcgtcctccagctcttcttctagaagggccattagacgcttacctgtttcaaacgagcgaagcatatttgggaactgttgaaccagcgctcccaaagcaatgaagactccttcgatatagttgacataaacaaagagtttcccagctgtaactccatcctgtcccgcaagaaattgatagccgactaccgttaaaatcgcagcaatgaccaaattttgcagaaaaccactcagattccacgtggcaagagactgggcccagataatcttattatctgcccgacgcatcttgtcagcagtcacttcaaattctttcatgatgcgctcttcttgtccaaaaagttgaatcaaacttgcaccattcatggtctcattcacctgcgtattgacgtcactccttgcatcataaaaatccttcatcggcttgtctgtcattttcttgtaagcaaattgaataccgatatagagtggtatcaagagtaacatcagccaaccaagactcctattcatataaaataggacaccgtatgtaaagagcaaacgaacaatattgttaaaggcattaactaaggtcccataaaattgtgtccgcagagtttctgtatcattgacaattctagttgcaatttttccagcgggcttatcatcaaaataagaaataggcaaccgttgcataacatcgtaggcttgattacgtagattttcagcaatacgattggcgcaatgcatgagtaaacgcatagataagtagaagccaatagctcccagaataatcattcccatgtattgaactgactggtttaagaaaacagcttcatcaaaaggcaaacccttgctcaaatccgtaatcggcccatcaatcgcctgctgaatcagcagaggagccaatcgaaccatggtcgaagccaatagatagaagccgacagctactataaatagacacttgactcgacggatttgttttaataaaaaacctaaaatagtcattactctcctccttcctggctttgttgtcgttggtattgttcatagtaccaacctctttgggcaagcaaatcagctggacgcccttcctcaacgatacgcccctcatccaagactagtacccagtctgcatggttgacagcagatagacgatgggtcacgatgacattggttttgcctgcacgttctttttgaatattttggataatctggcgttctgtcctagcatccactgccgacaaagaatcatctagaattagcaaatctggctctcgcaggaaagcacgggcaatggaaatccgttgtttctgaccaccagaaatagacacaccacgctcaccaatcatggtatcaagaccatcactcatccgttttaaatcttgactaaaagctgctgtggcaatggcttgttcaatctcctcagagctactagctactttccctagggcaatattttctccaacagaccttgaaaacaaaatgtgttcttgtggaacatagccaattttttcctctatactagaacgtttaaagtctaaaatagattgatgattgatgaaaaaatttccctgaccaatcggatactggcgtaagaattggcgaaccaaggtcgtttttcccgaaccagttttcccaacgatacctacagtttgccctgctttcagtgtccaattgatgtcctgtaggctggctctttccgcctgtggataactaaagctataatttttgaaggaaatactagacagctctgcaatttccttagaaccatcagcctccaaatcatcacccgtctcaatcagctcttgcagtttttcgaaagatgtcttaccagtctgataaacaaggatgaaatctgctagtgtccaaaacggctctaaaagcgaaccgacatacaattgaagggcaattacttgtcccaaggtcagttgccctgctttcacggcttgtgcccccatgagaagtacgaaaatagtagacaatcccaaacagactgtggctaatggattatacaatgattgcaaggaagtgatgcgatccccaccttgagccaattgcttggtacgagcttgaaattgagccttttgatttgcttttttactataagcccgagtcactcgaatgccttcgatgacctccaaaacttcattattgagctgggctacagcttctctattggcatcaatcgccttatcttgttttctcccgataaaaaatatacatagtgtcatgaacagcatcggtagtaaagctactagcgaaattttccaatcaataaagaacatcgtgggaatgataaaagccaacataccgcctgcatagacgacaatcataagaccgtaacccaccatctccatcaggccatccacatccgttgaaaaacgagtcatgacatctcctgagcggaatttttcataaaatggagtccgcatggtcactaattttttaaaggcacgttgctgcatatcaaacttgaaattgacagaggcctgaaataatttcagatgccaaatgaaggctgttgcatagttcagcactgttaccaataacaataaggtcatctcctgaaccaatatggcctgtgttaattcattcttggttagtatatcgaccatccgctgaatgatttgcgttggtagcaaaagtgtggcgtcataaataatcaaggtcacagcaaccaatagatagagccacttatgacgcttgatatagtcaaaaattaatcgaaacatatatctcctttacaaatccataacctatcatttgccactttattcaataagctacaattgatagaccttacttttctaagctaagcgcacaaaaaagcccagggaagcatctcactccacctaggcttgcgtaagtccacaaaaatagaccagctcttgaacatagtcgacaatttttatcacaccatacccacagtgcttgattgtctcaatgtttcaaaatatagcccacgaaaaacgacaaaagttcatcaatgagctttgttttcctgcttagaaaggagtgtatgataaaaaatagcttgctgaatgacaagttgcttgttcatttgttttactcctttcatatttctaagccctattctaccataataaacattcatgtcaagggattttttgacaataagggcgaatttaggacaaaaataagaaaaaaccttgtcaaacaaggcctttcgatagtattcgatgctagttgccgggattgaaccggcgacctcatccttaccatggatgcgctctaccgactgagctaaaccagcagtacttgactagtatatcatatctctaaaaaaagtcaatggattttttggaaatattgagaaaaataaagagaaaataagtcattcctaaaaattgtctgacacttttaaggaattgtgctatactattgttataaaaatcacaaaggaaacgatatgaaactgcaaaaccttcaagttggacaatcttatttagtcaaagattgtctaacgcaagatgatattcgtaaacacttagcacacttgggtttaaaagtcggagaagagattcgcatcatttcaaaaaccaagaccaatgcaattttccaagtcaaggcaagccgtctagccctagacagagaaattattgaatctctggttttaacagaaaagtcagctacggaaataatcaatctatccgaggcacctattggtagctcagctaaggttatggacatctatgcaacaggtgcactccgtcgtcgcctcatggatatgggacttacaaagaacacgcagctatttctcaaaaaagtcgctcccctgggcgatccaatcgaaactaccttgagaggatacgagctgacactacgcaaatccgaagcgcaaatgattggtgttcaaatcacaagcgaggtgaggaaatgacaaaacacatcgcccttgcaggaaatccaaatagcggaaaaacaactcttttcaacctcctaacaggaaccaaccaacgtgtcggtaactggcctggagtcaccgttgaaagaaaatctggaacgatcaaaaagcgaaaacatttactaattcaagatttaccaggtatctactcgctgtctccctacacaccagaagaacgggttgccagagattatttgatagcggaccaaccagctgctatcctcaacgtccttgatgcaacaaacttggaacggaatctctatctgaccttgcagttattagaaatgggccttcctattgttatcgccctcaatatgacagacgccctgaaaagtcaaggtcgctcaataaacagcgaccagctctcctatcaactgggagttcctgtacagcctatcagtgcactaaaaaagctaggtatatcccagctcctccatgaagtagaaaaaattaccaatcagcaagccgagccaatctatcctcagtatgacaaacaatttgaagccggcctcgcccaagttattgacctattatcggattccatcccaaatcgtcaaaaacgcttctacgccattaagctactcgaacaagaccaagtcattctagaccaattgcaactaaatgcacaagacatgcttgatttgaccgaaatcattgccattttggaaaaaatttacgcagacgatatggaagccattatcgtcaatcaacgctaccaatttatcgagaaaatcacagaactggtcacaaaagacagcgataaggcttttaacctgtctgataacatagaccgacttgttaccaatcgttttcttgccctccctatctttgcggcagtcatgtggctgacctacttcctgtctattcaaacggtaggtacaatggggactgactgggtgaatgatgtcctcttcggagagcttgttccaggccttattcaggcaaatctagatcgatttgaaatcgctggctggctacaatctctggtccttgatggcattattgcaggatgcggagccattctaggttttgtaccacaaattttcgtcctcttcgtctgcttgggaatcttggaagacatcggctatatgagccgagtcgcctttgtcatggataggatttttagacgttttggtctatcaggcaaatcctttattcccatgttgatttccacaggctgtggcgttcctggagtcatggcaagccggactattgaaaatgaacaggaccgaaaaatcaccattatgacagcaaccttcatgccctgttctgccaaacttcctatcatttcactggtagccggtgctttctttcctgacaatccttggattgctccaagcgcctattttgtcggtatggctgccatcgtcctatccggaatggcactaaaaaagaccaagcaacttggtggagtcgcaagcccctttatcatggaattaccatcttatcacttaccaaaactcagtacggttctccggtatgcattcgataaggcacttagttttatcaaacgagctggtaccattatatttgtgaccaacatcattatttggttcagcagttcctataattggtctttacaaatggtagaaacagatgagagtatcttagcctccattggacacagtttttctctcctctttgccccacttggtttcggaaattggcgagcaactgttgcagccattacaggtctcttagccaaggaaaccgtcattgccacctttggtatcctctataaattaggagaaacaaccgaagaaaatcccgaactatgggggcttttacaacaagactatacagcgttatcagcctactccttcctagtcttcaatctcctctgtgccccttgttttgcggctattggtgccattcaccgtgaaatgggagaagccaagtggacatggattgctatcggtttccaaacgggtttagcctatgcaagtagtttggttatctatcagattggtcttgtacttatccacggacaattaccaaccgtctggacatttatcgctatctttctaattatcacagccatctacagcctagtgaaaaaaccaaccaacactcttccaatcgtcacgctaaaaacattagaaaaaggagaatattaatgcccacacttatcctctttctcatcatcgtcatcttattttctcttgcgattcgcagtctcatcaaaggaaaaggatcctgcggagattgttcctgcgactgtactattaagcaagagatgaacgaatcttctcaccatagacatccataacaaaaaggtctgcctcattattgtgcagacctttttacatgtagcttgtctattaaatttttaagtagcggttcatggaaatgactgatcccaaggaaccaataataataccaattacaaaaagtgcgccaatcattcctggaacaaagacatccatactaatcagagacaaatcttgactagcaagactagcatttaccgaagtataaatcatcttataaaaagaatagactaaagcagaaggcaaaatagctccgaggagacctacccaggcaccttcccagaggaatggtccacggatataactgtttttagcaccaaccagacgcataatctgaatttcacggctacgagaaataatggtaattcgaatagtattggaaatcaagaaaacagcagtaaagagcaataagccagttgctgccaatccccatgtacgaactagattagctaatttaaaaatacgttccgtttcaacttccccatcccgtacctctgtaacaccatcaattttagcaatctctgctgcaacagtttttacatattgcggttcagtcgtatcaatgatataagcatcgtaaagtggattggcatctccttggaataggttccaagtatctcccaaggtagctgttaatttctgtaactgttcatccttacttgaataagtgacagattgtacattttctaaggctgtaatctgattatacacctttttataatctggattagctaccgtctctcctgcttcgttcacaatcgtctcagcttgatcggttgaattcgctctcaaatacacattgatgcgtacattctgttccaaatccgaagcgagctttgctgtgttcaaaataactgaagcaaatagaccaaccaaggtaagggtaatggctacagatgaaatggctgcaatcgtcatccaaccatttcgcttcaaactcttcaatgactcaataaagtgtctaaaaaatcgattactcatcgtatccatattctccttccgcttcatcacgtactacacgaccatcttcaatcgcaataacacgatgacgaagtgtatttacaatctgactattgtgtgtcgccatcaaaatcgttgtcccctgtaagttaattcgctccaatagattcatgatttcccaagagttttcagggtccaagttaccagttggttcatcagcaatcaatactttaggattatttacaatggcacgggcaatagcaatacgctgttgctcaccacctgaaagttcatttgggaaagaacgaattttgtgtttcaaaccaaccaaatctaaaacttccattacacgtttcttgatattccgtggtttctcaccgataacttccatcgcataagcaatattttcaaagacagtctttttaggtaagagtttgtagtcttggaaaaccactcctacactacgacgtagaagaggaacatctctctttttaatttttgcaaggtcaaacttaccaacctttagactccccttatcgagcttttcctcccgatacaagagtttgataaaggttgacttacctgcaccagaaggacctacaatgtaggcaaattctcccgcttcaacattgactgatactccgcgaagggcagtcgttccgtttccatatttcttggaaacgtctttcatttctattattcccataggatttcctgtcttagacagtcctttctttagatttgagaacgtttttttcaaaatacagtccgtattctctaaaaaaacttccttgatgagcgaaaaactatctcttatttacaagcacttcacttgtaaatacaggttcttagctaattcgccattttaaataagcatctataaagccgtccaagtctccgtccataaccttatcgacttgagccacctcataaccagtacggtggtcttttaccattgtataaggtgtaaagacataagaacgaatctgacttccccaagtgatctctttcttgtcacccttaagtgagtctacttctgccgctttcttctcctgctccaattgatacaatttagcctgcaagagtttcattgcacggtctcggtttccatactgagtacggtcaactgtggactgagtcacaatccctgtcggaatgtgcgtcaatcgaacacccgttgaaaccttattgacgttctgtccaccagcacctcctgaccggaaggtatccatcttcacttcatcatctctgatttcaatttcaatggtatcatccaactcaggcattacctccacagatgtaaaggaagtatgacgacgcttagctgagtcaaaaggtgagatgcgcaccaaacgatgaacacccatttctgacttaagcaagccataggcgtttggaccagtaaagcttagagtcacagacttaatacctgcctcatcaccagcttgataatccaatgtttctactataaaacctttggcatttccataacgctgatacatccgcaggagcatttctccccagtcttgtgcctcggtaccacccgaacctggatggatttccaagatagcgttattgtgatcatagggttctgataagagcaaggtcatttcgtaagcagtcatggttttgtccaattccactaacttttcaaccaactcatcccgcacagactcatcttctgctagaaaatctagcaaaatttcagattcatcatataaatccaacatctgatggaaatttccataagtattttttaattcattcaactcctgagacgtcttctgggctgccaaattatcattccagaaatctggctccgtcatcttgttctcaagaatggcaatctcttcttccagaccttctaagtcaaagagaccccctaaaagaagttaattttttgccaagttcttcaatcttttggcgaatttctgctgtatccatatacacctcatttttattcataatctttattatatcacatttgcaagtccttgaccatgttgagaaaggccgcttgctctgctatgacatcatcattgtctgatgaaatacctgcgataaaggaaaccatctcatcattgggctgtttgaccaattgccccaaggcccagatagccgttgccatgtggaccggattttgttttttatcgatgatttctaggagtttgggaatggcagagcgatcattactattagccaaggctatgatggcattacgctggagaatatttttcccccgccaagaacctgcaatcataccaaatttttccttgaattgtccatttgacaagtccaagaatggaatcagctcaggctcagccaaatcagggtcaatctccaccacaggtggactggaaattcccttgttgtaaggacaacaaatctggcaaatatcacaaccatagatgaccgtcttgattttcttacgaaactccaagtccatcatccccttatcctgggtctgaaaggacagacagcgacgggcattcatggtcgtgtcacctaatagacaagacgtcggacaggctgcaacacagcgattgcaatcaccacaatcataatctactggttgatctggttcgatgtccaggttggtcactaattctcctagaaacatataggaaccaaattccttagaaatgactagcccattcttcccgataaagccaattcctgcacgacgagcgaccgctgtatccaccaaagctcctgtatctaccatagccttgtattccaaaccatccgtcagtttctcaattccccgtgccaaacgctccatcttatcttgcaagatatagtggtaatcaagcccccatgaactaggggtaatcttcccacgtttgtattgggtcttctgcggtttgacaggcaaatgtcgaggataagctaccgcgatagaaatgatagtttttgcagattctaacgacagtttgggacggatacgttcttcaatattcttgtgttcaaatcctgacgaacgcccctcttcctgactagcacgaagtgatttctccaaataagcaaaatcatcagccgttgtaaaaccaatcttcgagattccgatttcctgagataatttaataatctcttccttaatattcattatattcattttagcaaactttgaatatatttagcaagacctacatggctaaataagttattaatataacaaaaaacgttagcacaaaacaaaaaatattcatacgaacataggccttctcccgccaaatactggtcaagacatacatgatattaataccgattgctccccctaagccgttagccagtaaatcagttatatctgcaaccccaagtaaaagaagatattgcagaacctcaaagcagagactcactaacataatcaaacatagattagtcacccacgatgccttgcgaaatagcatttccatataaataccaaagggaataaaacttacaatattaaatagaatttctggaaaatccagcactccatcatagaccgctgttcctgcaaacggaattaagtttatactagcataaccatagcgtccatatacgatgctcaagtccatcttaaagataatcatccaagtaagtaaaaggagataggcaaaaaataaaaacatactcattttctttgtctgcatagaaattctcctctcaactagcatattttatcattatatcataaatgctgttctataaaatgtcacttctgtgacaaagctcgttccatattacaagtactttacagcctactaaaaacagaaaaggaagacactaccaagcctccccttattcccaaaaatatcttacttaaaatgtctgattgctatgctgaaaagccttatattgatggatttgtagcatcaaacgctcaaagttcgcttccttacatgctcgcatgatcaagaagcaatcaataaacttccacaaataaagtcccaaaaataacaagaacccaatcaagataaatagcgtaacaaaagatactgcaaaagcaatcagcttggcaaatcccaattctttattcccgacataaaaacggtcgacaccaaactcaccgaagaaaatagccaaaataagagcgacaagaggttgacgcatctcaaccatcataagaacgtttaaagcctcatcatctaaatcttctagttctttttgcagaatgaataacttatcagatggcaaataactgcttttacttaaaatataattctgaagataattcatataaactcctacctcttcaaaattatagcagtttcttattcttcaagcaagcctgtaggggaaaacagtgtcagaaatcgtttacatttttttcttttttgctataatgaaactagattacaaggaggttcatatgagagttattattcattatccaaaacctatcaaacaactatcctcccaaaaacttccgctcctggtagatggaaaaattgctgggacagttactcaaggtaaaattctaagcttaccaattacacaaccatctgttacactaagcattcgaggggataaaaaatcgagcattcaagttaaggagggcgatagggtctaaataatatagtcgaatgaattagctttcagacaaggaactgaggcgcaggctgtactgaagtacggcaaggcgaaagtgacgatgtatcaaagctaattcagatgactatggaaagtagcaaatacttcactccctactatttcagcttggctatcgtaccaatcgccttactgtttaacttaccaactcttgtcaaaaccttcctcctcatactagcactagccattactttattgggacaagcaatcttcccaaaatacattatcagtacagaaaaaagctcagaccactaaatctgagctttttcaaatgatatttgcttttagtacaaggtaacgaggcgcaggctgtactgaagtacggcaagtcgagttaacgaagtaataaaagataagctgaataactatattagatagctttttcatccaatcccaacttacgttgaacaaatttaacaatttctacaacgacaaccatgagacctgaaccgattactgttaccatccactgagttggtgtcaagatagataccttgaagaaggtattgaatcctggaatcacaacagtcgccatcaagagcaagaaggcagctacgatagaccagttaaagagtttgttcttgaatggaccaacggtaaagatagattggtaaacagacttaacgttgaaggcatgcaccaactgaatcaatccaagagtaacatatgccatcgtaagagcatccgcatgaatggcatgattatctccagcgtgctctgggtaaagaagtgcaaaaccatatacgcccaagacaagtgctgtttgaaggataccttgatagataatcgaactcaagacaccacctgagaagaagcttgagttacgaccacgaggtttgtgctgcataacacctggttcagcaggttcaacaccaagggcaatcgctggaagtgtatctgttaccaaattgatccaaagaagatgaactggctccaatacgtcccaaccaaagagggtagcaaggaagatacacaatacctcagcagtgttagctgacaagagatactggatggttttttggatgtttgagaagactttacgtccttcttcaaccgccacaatgatagttgcaaagttgtcatctgcaaggaccatatcagaggcacctttcgaaacttccgtacctgtgatacccataccgataccgatgtcggctgtcttaagtgatggtgcatcgttaacaccgtcaccagtcatggcaacaaccttaccatcattttgccaagccttaacgatacgaaccttatgttctggagatacacgagcgtatactgagtattgtttgaagactttctggaactcttcatccgtcaattcgttgagctctgcacctgtaaatacatggtcttctgtatcatttggatcgatgataccaagacgctttgcaatcgcctcagctgtatcttggtggtcacccgtaatcatgattggacggatgcccgcttccttagcgacacgaacagcttctgccgcttcaggacgctcagggtcaatcataccaaccaaacctgagaagacaaggtcgttttcaacaacgtcagattccaattcaggaatagcatcaacatacttgtaagccatcatcaagacacgaagtgcttgcttagccaagtccttgttagtggcaagaatggcttgtttatccgcatcggtaatcggacgaattgtaccgttttcttcaatttgcgttacacgtttgagcaattggtctggagcacctttaacagctacaaagaagtttccagcagcttgttggtgaacagttgacatcaatttacgtgttgagtcaaatggcaattcagccacacgaggctccgataccaagacttcacgaacgtcaaagttttgatccaaaccaaattgaacaagtgccgtttcagttgggtcaccaatcaatttaccagttgggtcaacttttgtatcgttggcaaagttcataacacgaagcgttgtattgcttgcatccaaagcttctttagcatccaccaattgaccgtttgtatagactttttcaacagtcatctggttcatagtcaaagtaccagtcttatctgatgcgatgatttcagttgaaccaagtgtttcaacagcaggcaacttacggatgatggaattacgcttagccaagacctgtgtaccaagtgaaagaacaactgttacaatagctggcaaaccttctggaatggccgcaaccgcaagagctacagaagtcataagagcaggcaagataccttcaccacgtacgaagactgaaacagccatcgttaccgctgcaattacaagaactgcatatgtcaagacttttgatagctggtgcaagttttgcttcaatggtgtatcagtctcatctgcattagcaagcatgccagcgatgtgcccaacctctgtgtacatacctgtatttgtaaccacaccaagaccacggccgtaagtaacgttagagttttggtaggccatgttgacacggtcaccgattggtgcatcttcagccaaaactgcggacaaatctttatcaactggtacagactcacctgtaagagctgcctcttcgattttgagggagttagcttccaacaaacgcatatcggcagggacaacatcacctgcttcaagcaagacgatgtcacctggtaccaagtctttagaatcaacttcgactacatgattgtcacgaagcgcacgcgcaactgggcttgacatgttttttagcgcctcaatggctgcctcagcttgaccctcttgataaacaccaaaggcagcgttcaagataaccacggccaagatgataatggcatctgtcaaaccgtgtgaaccttctgtaatcaccgtcaagattgctgctgcaatcaaaatgataatcatcaagtctttgaactgatccaagaatttagctaagagtgtgcgtttttcaccctcatccaattcgttacgaccgtagtctgctagacgtttgcttgcctcatcactagacaaaccgtccaaagaagaccccatgcttgacaatacttgctcttcgctctgtgtataaaacaaatcgcgtttttgttcttttgacaatttccttctccttctcggtcccttttttacctaacaaataaaaaagagacctgttttattaaaacaagtctcgctatttaatatattgccggaaacaagtcggattgacgacaatatcacggaattttccgctagctactccctcgatttgttaactattatatcaaaaatcccgagaaattcaagaatatttttctggaaataagagattatttccacgaagtaaattcccaaagtaagttctagtctgtcttaaaaactggaaattagactgagacaaagaaataaggtagaacttactatgggacaagttggtaactgacaatgaaaaacaaacacttaactctctctgatcgcaatgatattcaaataggaattgaacaacttaagcccttctcagctatagcagctaagttaggaaaagatccgtccacaatttcaaaagaagttcggagaaatagggtgataaaagagaactctagtacctccaattgtgaggcctgccctctactcaaaaagactccttacgtttgtaatgcctgtccgaaaaagagaagcaactgcggataccagaaacagttctactacgcaaaaagagctcagcttgattatgaagttaagctctcagattcgagaacaggtgttgcactaaacaaggaagaattctatcgcatggatgagattgtttctgctgccatccaaaagggacaacacctcaaccacatcatcgcctcaaacgaaatgtcggcatccagagcttctatctaccgataccttgaaaaaggctatctgtccacaaagcccattgatttcccccgtgtcgtgaaattcagaaagcggagaatcagaaacctacaacccattcctaaaatcgccaaagaaggacggtcttacgaggacttccaacgctttctcacagagaaaggaatcagctattggctggaaatggacaccgttactggacggatcggcggaaaggtacttctcacctttaacctctccttctgtaactttatcttcgctcaattacttgataataaaacagctaatgaggtcgctaaacatctctacgctatcaagaatgacctgcatcagaaagagatggacttttgcgaaatatttcctgtcattctgaccgataatggcggtgaattcgctagagtggacgatatcgaaatggatgttcgcggagaatctaagctattcttctgtgaccccaatcgttctgaccagaaggggagaattgagaagaatcacacacttatcagagatattcttcctaaaagaagttcttttgacaacttgacacaggaggacatcaacctggtttgttcgcatatcaacagcgtcaaacgagcttctttcaacggaaaatcagcctatgaactctttacatttacctacggtgaggaattggcaacacttttgggaatctctaaaattgaccctgagaacgtcattcaatcacctcgattattggataagtaatcgctagtttttatcaaaaaataatttcaaaatagaaaggaacttgttccatccaaaattccagatagctagaacttactttgagacgtctcagagccagtaactttagtgtactcttttttcaacattttcaaccctaaaactcactattatcaacatttttagtcaaaaacagaacttagtctgagactaaattctgttgatgttatgcagttttctcagagtaacttctggaaggacgggaactagaacttactttgagaatttaccctttcatttgttttcagttgtatcattcacagacaaaaaaagaacgactatcagtcgttcttcaataacatacggaagacatgggattcgaacccacgcacgctgttacacgcctaccgcgtttccaacacggcctcttgagcctcttgagtaatcttccatatatggagctggtgggagtcgaacccacgtccaaacacctgctaacttattcgtctacaaccataggttatgtcttgctttaactttaacttgaactcgatacataactcaaacctagaccaagcgagtcagtaaatctcttttggaactgcctgactcaatcccaacgtagcttgctattttaagaccaatcagcaaacacaagcaattcgcgactggtcacgcaggcaggttattaagctgctaatgcgtaagtgtttgtattttttgcagttatatttaactggcatttttacatctgccgatgagttgcagaacaagcctcataatgcctgtcgaatccgtaacaaccccgtaggatttgatacaggaattattatagcagaattttttataaatagcaaaattattttacattttccttacaatttaaaaaaattttgaaatatggtaaaatgaaagtatgtataaattttggcaaaaaaccattcaagtattaagtattttgacccttatcgggaccgctatttttctattttggctctataagattggcattttgaacgaccaaaatgtcttaagcgatttaatcaaaagccaaggtgctttaggtagcctctcctttttagctattcagattattcaagttgtatttccgattattccaggcggtgttacgactgttgtgggtttcctcgtatttcatttttggtggggattctttctcaattatcttggaatttcaatcggtagtatcatccttttctggttggctcgtcgctatggaaagaaattttgtctcctcttcatgtctgaagatacgttttacaaatatgaaagcaaaattgataataaacgtagttatgaaattttctttattctctgcatgctttctcccatttctccagctgacatagtggtgatgattactggattaacaagcatgagttatcggaaatttattatgattactttactttgtcgccctttctcagttgtggcctatagcttcttttggatctatggcagccaatggttgcagcaattgttaggataaaatcataaccacccgtgaaaacgggtggcttgtacaccggctataagccgtttctctccagcgacgtctaaagacgttcgctgaacttcgttcaggttagtgctataattacttgactaatgcccgtaacaacgggcttttatcttgttctaaaactactatctgaaaatgaatcttcatattctttaacacttaacttatcaagtgcgatgtcatttttctcctgctcgcgaatatatttcgctaccgtcttttcgttcagtccaacggtactcacatagtagcctctagcccaaaactttcgatttccatacttatattttaaattagcatgtttatcaaatatcatgagagcacttttacttttcaaatatcccataaaatcggaaatcgaaagttttggggatatcaagacaagcatatgaacatggtctggcatcatgtgtccctcaatgatttccaccacaccaaacgcatgaagaaaaaaacgttttcagaaagcgaaaatcataaccaaagatcaatcaaagtagtacactagaatagaggtgaactacaataattgattttcttttatccatagaagagcacaaagaggagtacaacagccgtcaagcatggaaaattcgttatcccttatccactattctgtttctagttttcgcttgtcaattggcaggggttgaaacgtggaaagagatggaagatttcatagaaatgaacgagtctgttttgggagaatacgttgacttgagtgtcggctgtctttctcatgacaccttggaacgtgttgtgagtatggtcaatccagatttcttaaaggaactgaaactgtccttcgaagctagttcggaaacaactgatttttcaaaattgattgccgttgacggaaaaacgattcgggggaaccgagggaaacaccaatctcctactcatattgtcactgcttatgatggtggtaatcggattagccttgggcaggtagctgttgaggataaaagtaatgaaatcacagccattcctcgcctcttgtgtcagctagaccttcgtaagagtgttgtcacgattgatgccatgggcacctagacagacattgcggatgtgattatcagcggtaagggtgattattgcttggcagtcaaaggaaatcaaggcaatctccatgaggatattgacctctattttagtgacgccaaattgttatctacgttgacagagaaaggctgtcattatcagaccattgaaaaggcacgcagtcagattgaggtgagggactactgggtttctcacgatgtgaaatggctgagccaacgacatccgaaatggaaaaaacttcgtgggattggtatgactaagaatatcattgataaagatggtgtcatcactgaagaggtccgttactttatccttagtttcaagggcgatgtgcaaactttttctcaggttgttcgtggtcattggtcggttgagagcctacattgattgttagatgtggtttaccgagaagataagaaccaaaccttagataaacgagctgctttcaatttaaatgctattcgtaaggcttgtcttcatctcttacaaatgatgaccttccctaaggagaaattgagttaccgccgcaaacaacgctatatttctgtccatttggaggattatttgccacaattatttggaaatcggggataaggtgcttgtaaaaaggtagatactaagtttaaagcagttatttccggggacaaaaggagagaagaaatttttcatgcgtatgacgtgatgtccacgcctttgcatcgacatagatgacggaaaatatcaattaagtcctgccttattttgtagtaaatggattttctacggtacttaggtgtgaaaactatgtgatagagcacatccatttagtatgtgataaactgtaactggttttagccatttctttttcctccttgatctaacctgaacaattagattataacaggaaaaagaaatggaaactcaaagccttggcagccaccagcatagctggtggctttcttgtttttctctacgagaaaaactggctcgaagccataataaaaaaacggcttcaaacgttcgaaaccattttgtttttttatttaattcctaatgcaattcgagcataacgactcattttttgaacggtccaagctggtgaccaaaccagtctcacatctacttctgttacttcagggacatccttcaatacatcatgaatttgatcggtaattagatcagctaatggacaacccatggtcgtcaaggtcatatcaatttcagccttgccctcaataaatcggatttcataaattagccctaaattgataatatcaatacctagctcagggtcaatcacatcttcaagagcatgaaaaatacgctcctgaatgtctttaatttgatcttctgtgtacgtcatttttctctctttctttttcacaagttcaatactagaaaagaaacaaacgaagtttgtgtcaaaaagtccactggacgttacgctccctttctaatttcaaggggagcggttaaaatctcgctcgtttcctgttttcagcgagcggttgattttgtctcccagacaaaatcaatcctcaataaaatctcttagtggtttgctgcgggatgggtggcggagtttacggagggctttggcttcgatttggcggatgcgttcacgggttacgttaaagactttaccaacatcttcaagcgtacgcattttaccatcatctaaaccaaaacgaagacgcaatacgttttcctcacggtcagtaagagtatccaatacctcatctaactgttcacgaagaacgacacgagttgtgtaatcaactggattttcaatgacttcgtcttcgataaaatctccaagatgactatcatcttcttcaccaattggggtctcgagtgaaacaggctcttgggcaatcttgaggatttcacgaactttctcaggcgtcatatccatacgctcagcgatttgctctggagttggatcttggcccaattcctgcaagagattgcgttgttcacggaccaatttgttaatggtttctaccatgtgaacagggatacggattgtacgcgcttggtccgcaatggcacgagtgatagcctgacgaatccaccaggttgcataggttgaaaacttgaaacctttagagtagtcgaacttatcaacagccttcatcaagcccatgtttccttcttggataagatcaaggaactgcataccacggccgacatagcgtttagcaatggatacaaccaaacgcaagttggcttcagccaaacgttgtttcgcttctgggtcacctgcctcaaccgccaatgccaattcttgctcttcctcgttggtcaaaagaggtacaacaccaatttctttcaaatacatgcggactgggtcgttcacttttgcagaagtgcttccgagcaattcttcatcagataattctggttcttcctctacctgcatagcacgagcagaagggttcccttctttatcaacaatcgaaatccctgcgtcctgaatacgttggagcaaatcatcgattccgtcagcatcaagcgtaaatggaataaccagttggtcattgatttcatcgtctgtagctgaaccttgttttttatggttacggataaattcggcaacttgtacatcaaaagtagttacttctgtttttttatcttttttatttgtcatatttactccatttgtcttcttctatcgaggagtttttgcaactcatcgagggcaatatctgcatttcccacatgggaatgttcacggattttccgtgctaggtgctggttctccttctttaacaattccttgtctcgccgaatttctaattcttcgatttcgtgtggagacacttcatcaggtaaacgttcttcctgcatacgataccaagcctgttgagcggaatcgttcaactgtgatagttcaaaactggtaatttccccagatttttttaacatatcataaatagcttgcaattctggcgtcgcaaaataaaaatcttctcgtaaacggaactcattgagaatataaggatgttcaaccatccgataaagtaaatggttttctgttcgaataagactcgttatacgagcaatcgtttggactggtggcaaataagactgaccagtctgtgattgaaatacctgttgtgttctctcctggcgctgattcagacgaacagcatttactgcctgttccacctgattataatcaaagtcagaaagtaaatccgccaccttataaatataagaattttgagctgtaatggatgatactttggcaataattggtgcaatcttatctacaaactcaatctgcatttgtagattgtcaggattttcaggtttcaagtattgaatcaaaaattctacatcgctgattcgtgacttggttaaaacctgttgcaaggcttcttccgaatttttctgcaaaaattcatctgggtccatattatctggcaagctcacgatttcaacctgaaaatcttgtagttcgtccaacgctttcatggtagcagcctgtccagccttatccccatcataagtcagaacaattttcttacaaaacttagctaggtgtgcaacatgctctcttgtcaaagctgttcccatggaagccactgcattatcaatccctacacgatgagcagcaataacatctagaaaaccttccatgagataggtttcacgttgcttcttaataaccgctttagccttgtccaaatgatacaattcatagcttttattgaaaatcgcagtactacgagagtttttatacttggctaattgtttattgtttcgattttcttcggtccaaatccgacctgaaaaagctacaattcgaccatattcatccgccaaggggaaaataatcctcgcttgaaaggcgtcataaataatattattctcacttggattgaacaaacccgaattcaatagactttcttcgtcatattgacctgatagtttttggtaaagaatattctgttcggcaggagctaagcctagctggaatgtttttatgacatcatctgtcaagccacgttggtgtagataagctctagcttcctcacccattttagttgtcatcaaaagggcatgataaaactttgcagcatcccgatgaatatcatacagtacctgatgcggactaacccttttctcctcttgatgataggaaggagttacatctatttgaaaccctgccttctcagctaagatagctgccgcatctgcaaaagaaacaccacgaacttcttcgacaaacttgaatacatctccggacttaccacatccaaaacaatggtagaactgcttatcttcaatcacattgaaagatggggttttctccccatgaaaagggcaaagaccgacataattacgtccggccttagtcaaagcaaccgtttcaccaataacatcaacgatattgagagcttgttttatttcagtaattttatcctttgaaagcacattccctcctcatatcatactagctaatttaaaaagtgaacactctccccttagtttaacatactctattgtatactaaatatgggaaaatgtaaaatttctaaaacaaattgcttgtaaaatatttttttatgggtataatagataaagtaaaatatttatgaaaggacatatttaggatatgttgaaagatttaaaagcatttttgttccgtgggaacattgttgaccttgctgtagcagtggtaattggcggagcgttcggcgcaattatcaaatcatttgtaaatgatatcatcactccattgattttgaacccagctttgaaagcggcaaatgtacagaatattgctgaccttgcatggaatggtgtgaagtacggtagtttcttgagcgctgttattaacttcctaatcattggcacttcaatgttctttgttgttaaagcagctgagaaagcaatgcctaagaaagttgaagagaaagctcctgctggtccaactcaagaagagttgcttgcagaaatccgcgatttattgaaaaaataatcaataatatattgaaaaacaggtctccatacctgtttttctcttccataattacaaaaataagatgtgagcctccactcacatcttttcttatccttcgtatccatttggatttttcgattgccagttccacgtatcttgacacatgtcttcaattgttttttctgttttccaatttaactctttccaagccttgtctgcgttggcgtaacaggttgccacatcacctggacgacggtcaacaagtttatagtgtactggaacgccatttaccttttcaaaggctttgaccaactccaatacacttgttccttgacctgaaccaagattgtaagtatatacacctgtagtagttgaaattttttcaagcgccttgatatgaccgagtgccaaatcaatcacatggatataatcacgcactccagtaccatcaattgtatcataatcgttaccaaaaacgctgagttcctcacgtttaccaactgctacctgtgcaataaacggcatcaaattattaggaataccagctggatcttccccaatcaagccagattcatgggcaccgattggattgaaataacggagcaatgcaatactccactccttatctgctacttccacatcacgcaagatttgttccaacataactttggtatagccgtacggattcgttgcgctagttggcatagtttcaaccaaaggcgatggattattgagaccataaacagtcgcacttgaggagaagacaattttcttaacactaaattctgtcatgacttctaccaaagctagggttgacatgatattgttttcatagtacataattggcttagccactgattctcctactgccttgtagccagcaaagtgaatggctgcctcaatgttttcattttcaaaaacttggcgcaaggcttccttatctgccacgtccaactcatagaaagttgggcgcttgccagtgatggtttcaatgcgatctaaaaccaaaatacttgagtttgaaagattatccacgataaccacttctttccccaacttcaacaattcgacaaccgtatgactaccaatataacctgcaccaccagtaactaagatactcatctttttactccttttcacctggacaaaattctatatccctattatatgttacctgttgtaaaaagtaaacaaaaaacagcctttcggccgttttcaaattcaattagaattttttacgcttgcgaactgcttctgatttacgtttacgttttacagatggtttttcgtagaattcgcgtttgcgtgtttcttgaagagtaccagctttagtaaccgcacgtttgaaacgacgaagagcatcatcaagtgattcgttcttacgtactactgtttttgacatttttttcactcccctcaatttcaaagtctttatcattttactatgattcaactcatttgtcaatatttttttcattctaaaatatgaattttacgctcttatcctatcctattcttttttcctgtccacgccagtattgtccaaaagaagaattcgtaaaggacaaaaaataatacaaagcaatgcaagaaaaactcttggggcaaaatatatatgacaggatcctttgcagggtcaaatagccatgtagaatctcctggaaatagcaccgtatgaaacaatgcaaaaaactgatcaaagccaacaagaactcctaataaaccgattatcattggcgtaagcatgatccagaaaatgacctttttaaccaagtctccataaccttttagcagaatgttttttacaaaaagcacaaaggcagggagggtgaggataaaaattccctgagttagatggaataaatgtttcacatccgcaaaatgtttcagaccatcagctgaggatgaaaaatttggcatgtctaaaacacttgcaaaaggatttgttagatagttcatcaggatattgaaattgtaggaaatatctgccaccttcatgtagaccactttttccaaccccaaaaaagaaatctcaagcggataaactagccaagctaggtagatggttcctagaactgctgccgataagacaaataaaatcgttccgataatctgtaacttagttctcatcaaaactccattcatctaggctgttgaggacatgggttggagccaggggtaagtctgctacttcttctggcttggtaaatcctgtcaggactaaaagagttggaaatccattgtcaatccctgcacgaatatctgtcaggtagttatctcctaccataactgtctggctgcgttctgtgcctaaaatctccagagccttgtccatgataatggcttcaggcttaccgataaaggtcggctctactcgggtagcagctttcaaaagcgcaataagtgagcctgctcctggcaaatgacctctttcagtcggaatgttcaaatcaggattggtaccgataaaggtcgctcccttttgaatagccaaggtggcaatggtcagtttttcataggtcaactgagtatccaaaccgacaacaacataggctggattttccgtgtcttccacataacctgcctcaaaaatggcagacttgagcccgtcttctccaatgacatagactgtcttttccttgcccaagtcattcatataatctactgtcgccagactggctgtatagattgtttcaagcggtgtctcaatgttaaagttttcagccaacatagcctgcaccatctcaggacggcgggtggtattgttggtcacaaataaatagggaatctgacattcttgcaagcgatgaataaaacgttcaccagcaggaatccgctttttcccttcataaatcgtaccatccaaatcaatcaaataacctgtatatgtcatttttcctccttaatcaaatcgtgtttcccaatgctcagaccgactagcttccaagcaaagtgctaactgctcagctgtatttttcccaaggtagagcggtggtaagtcatctagactgaaaaagccactggcaactgtttccgaattgggctgaaactccccgccaaggagacgacatagaatgaagaccttggtcacgcggtgggctgacttggcaggattgttcttgtgtttgtccaaaatcgccaccacacgttgagcctccacatccagccccgcttcttcctttacttccttgactacattgtccttgacagactggtccacatcgcaccaaccgcctggtaaggaccagagcccatcgttttcctgaaccagtaggattttatcctcttggaaaatagctgcgcgggtatccagcttgggtgtctgatagcctgtttcattgcaaaacaagtctttcactacttccaaaggctgtccagatggctctaccaacatttccgccgcaatctgtctgatttcttcgaaacgttccatgtcataaacatcttttccataggccaagcctgtctgagccaaggcttgtaaacgtacggcccattccaaccacttatcctgcgacatgacgttccctccattctatgacagcttgcgcatggatatgcccatctaccacaatctcatgctgactaccaccagcttctgccaccatacgcgaactcaccaagctagttgcctctacctctttaagatacttgagttgtatttttttagggacatggcagagcagaaaatcatagcccagtgcttcatacatccattccaaatacttgccattattgacatgcccattcatatccaagtcaaaatagcgaacaggaaattcttggacagatggattttccaagagctgatacttgggagcccgaggcaatttcttgacctgctcagactgataaggagcaatcaaatcttctggcacaggcgccaccttgcgagtttcaaaatcaatcaggacaaaatagcagagaatgtccaacaaaagattgcctgctgcatcgtagatatagaacatccgatgacagaaaaacttgttgtaggcaaccgcttctgtcttaatggtaatggtttcattgtacttaggtaaacgttgaatggtcagttcataatctgtcaccacccaaatcaagccaaattcctgaaaaacatagaggtcactgcgacccagttcttccgactgccgacctgatacaccaagacagtaggaaataaagtcaggtagtttgatttcttgtttgacatccaccatatcaaaaggaatggtgaactcttcttggtatgttagtcccataatgttgatctttctagtcttaaagtatagtctttcagttcacgtcaacagctgcaggtagcttcaatagtccagtggactattgaaggttggaaatcgtacttacgatagtaagtaacattcgtagagtacggcaaagtgagttcaaatactccagtggagtgtttgaagttggaaataaggaaacgaagtttcttcgctcgtcgaagtaataaaaacaaactgaatgactatatgaaacgctctgcaactgtatcgcccagaaacaatccctttttagtcatccgaagccaacagtcttcttcttgcaagagtccttcatttttcaagtctctgaccacctgaccgtagcggtcttcaaaggagataccaaactttttctcgaatcgctcaatggacacgccagtttttttccgtagccctaaaaacatctcttcttccatctgctcggtcttgctgagaaattcttcgtgtaagcgagaatggcctttttcgcggatggacttgaggtagtgctggatgggggcacggttgcgataacgcatgccgtcgatgtagcctgaagcccctgctcccaatccgtaatactcggagttgtcccagtacatgaggttgtggtggctttcaaaaccaggcttggtgaagttggaaatctcgtagtgttcgaagccgtttttctccaactcctgaagaatgtagtcaaacatatcggactccacatcttcgttgggtagatgaagattgccgcgacgctggcggttcatgaagaccgtgtgattctccaaaatcaaactatacaagctcatgtggggaatatctagctccaaggccttggcgacattgtccaccacctgctccatggtctgaccaggcagggcataaatcaggtcaatggaaatgttgtggaagcccgcttccttgagggccgcaatggtttcataaatctgggcctgattgtggctgcgaccaatttttttcaacatacggtcatcaaatgtttgaacgccaagcgacacccgattgcacttggactttttcagaactgctatcttatccgccgtcaagtcacctggattggcctcgatagtgaattcttccagctgtgacaagtccagcaagtcctccagattggtcaggaggtagtccaactgttctgccgatagagccgacggtgttccgcctccgatgtagagggtcttgagggctggaaggtcgtaaaacttgacctcttccatgagggctaccaaatagtcatcaacaggctggttcttaataaaaaccttggaaaagtcacagtagtaacaaatctgggtacaaaatggaatgtggatataggcagatgtcggtcgttttttcataagaactattatagcacactgtctataaaaatattttttacagccatcacttccccctcaaaacaatgatataatatagtaaacttacaaaatctacaaaagggattaaatcatgaacaaagaacgattctatgatgtcatcaacgctatcttatcattcttattctgccgctggctctttatgacctttcttttttaccagttcacgaccattttcatgacagttgatttttggccgacacttgccgcaatcctgttaatgaccggattttgctttaccctatttcgacttgtctataaaccccacatttcgcgactgacactttggtttttctacgcttgctacgggcttctgctagtctatcttctctttttcaaaagcatgggcgtcagaggtgtcaactagaatctccttagcactttttcacaagacctatttctcaatcctactatattggtttttaacctcttactctttttaccacttgggttgcttttttcattttcttggaaaaaactttctctctttgtaggtgctattttactggttgaagcctgtcaattcttcttttcactgggcttctttgaccttggcgacatcttgcttaacacttctggctttgcccttggaaaccttttgggaaaatccgcaatcgctcaatcttttaaaaatagaatacagaaaaaatgaccccgcaaggtcatttttagtttatttatactcaatgaaaatcaaaagtagcctaggaaacgaagccgacgatagaactgaagttcatctaggctcttgacaacggataattttgattttcgaagagtattagcttacttaacttccaaatgccagatgtcttcgttgtactgttgaatagtacggtctgacgagaagaaacctgctttagcgatgttgacgatgactttttccaaccagctgtcgcgatcttcgtagtctgctaacatctgctctttagtcgagatataatcttccaaatcaagcagggtcatgaagtggtcattgtgcttaaggttatcctgcaaacgccagagacgctcatcgatcccaccagcatgacgaatggtatccgatgtaataaagtcaatcaatgggcgaatggcttcacgttcgtagaaggaatatggatggtaggtcccatttgcatagtgttcgataactgtttggctatcttgaccaaagatataaatattttcatcacctaccaactcatgaatttccacattggccccatcatctgtaccgatggtcaaggctccgttgagcatgaatttcatgttacctgtaccagaagcttctttggatgcaagagaaatttgttctgaatgccgctggaataatataacttgcctcggttacgttatagttttcaatcataacgagttgcaagtgtggcgccacgtcaggatcatttttaatcacctgtgacaataccaaaatcaaatgaatgatgtcctgtgcggttgtgtaagcaggtgcagcctttccaccaaagaaaactgttaatgggcgagtagggatgttgcctgctttaatatccagatacttatggataacataaagaacattcatctgctgacgcttgtactcgtgcatgcgcttgatttgtacatcaaagatggattctggattaacatgaacaccttgtgtcttggcaatatggcgctgcaatttgcgtttattatgctgctttgtcttttccaaccaagatttcaattccttatcatttttgtaatccaacagcttttcgagctcacttgcatcgtgatggtagccatgtccaagtaggccgtccaggtagcttgccaaacttggattagcatgcatgagccaacgacggaaggtaatcccatttgtcttattattgaatttttcaggatatagctcatagaaagctttcaactctgaagttttcaaaatctctgtatgaagtgccgccaccccattgatggaataaccataatgaatatccatgtgtgccatgtgaacacggccatgttcatcgatgatattgacagcaggatcatccttcacttctttggcacgacgatccaattctacgatgaacggtaccaagtgcggaaccacatagttcagaaaatcaagcggccatttttccagcgcctctgacaagatggtatggttggtataagcagtcattttcttaacaatttcaactgcctcatcaaacgaaataccacggagctccaaaaggcgaatcaattctggaataacaagtgatgggtgagtatcgttgatttgaacaacggcataatcaggtaggtcatgtaagtttgatcccttagcaaccgcttcgtcaatcaatagttgcgcagcgttagacaccatgaaatattgctggaagatgcggagaacttttccttcatcggtcgaatcatctggatagaggaagagggtcaagtttcggaaaatatcttccttatcaaattctattccgtcataaatgatattgtcatcaactgaaccaaggtcaaacaagcgaagtcgattcttgcgttccattttataaccaggtacatcgatgtcatacaacttagatgtcaaggtaaagttagcaaatggcacctgataagaaatcggtgactctgttaaccatgaacgtggtgtaatccactcgtttggcacagcagactgctgatggtattcaaataattgtctaaacagtccaaagtgataattcaagccgaccccatcaccgttaagacctagactagcaattgaatcaaggaagcaggcagccaagcgccccaaacctccattaccaagagacggttcaagctccatgtcttcaatagcaatcaaatccttaccagctgccaccaactggcttttaacctcatcataaagaccaaggttgattaaattattagacaagagcttaccaattaagaactctgctgaaatatagtagacctttttcttttggtcatttgtatacttagcttcactctgctgttttgcaaaagcaagcaaggcgtaatagagttcttggtctgtacaatcttcaatgcgtttggcatacatagactgaacaaaattttgtaaattaatcatgagggctctcctagatatattaatgtaatcattcagaaaggtttcgctttacctttgtaaacgttttcttaattataccctatttataaaaaaagacaagccaacttccgtacaaatagaaattagttcgtcttttaaacgattgcaggttactacaatcagaattattcttaattattctgcaatcagagtttccaaaccaactttcatcatatccgtgaaagtattttgacgctcttctgctgtggtgtcttcctctggattaaccaagctatctgaaatcgtcataatggcaagcgtttgaacgccaaacttagcacctaggtaataaagtgcagctgcttccatttctacagccttgacacctagttgacctaattctaagttgcgactaaacaattttggagaatagaaactatctgatgataaaacattgccaacatgcgttgtcatgttgagttctttggcgatatgataagccttatctaaaagatcaaaatcagcgatttgtggcaaatcgtactctggccagtcaatattgatcatacgagagttggtcgcagctgcctgagccaagaccaattcacggacatggacatcctcattcaaagaacctgctgttcccacacgaattagttttttcacaccatattcgttaatcaattcatgagcatagatagatatggatggtattcccatacctgttcccatgacagagacacgatgacccttgtaggtacctgtgtagccgaacatattgcgaacttcgttgaagcaaacggcatcttcaaggaagttttcagcgataaatttagcacgaagcggatcaccaggaagcaaaatcttatcagcgatttcgcctggttttgcggaaatatggatagacatgtaatgtacctctttgttctattttcgaatacttacaactcagccaagatagccttcaccaagcccttgaagttgcccttgatttgctcggttacttctacaacttcttcgtgattaagttcagattggaaaccagccgcaaagtttgtgatagcagaaatacccaagactttcatgcctgagtgagctgccacgataacttctggtactgttgacataccgactgcgtgggcccccatggtcttgaaggccaagatttcagcaggtgtttcataggtagggcctgtcacaccgaggtagacaccatcgtccaacttgatacccaatttttccgcaacggcatgggctttttcacggtattctttagtgtaggcattggacatatctgggaaacgtggaccaaattcttccaagttttcgccaatcaatggattttggccagtcatgttgatgtggtctgtaatggccataagggtacctggaccgtagccaataccacctgcggcattagtaacaatcactccttcacaaccaagagctttcatgacacggactgggaaagtcacgacttccatcggatttccttcgtagaaatggaaacgaccttgaagagctaagaccttacgtcctgccaaatcaccgtaaaccaacttaccagcatgaccaacaactgttgatttaccccagtttggaatatctgcatagtcgatgacaatagcattttcaacttcttgggccaattcacccaagccagaacccaaaatcaaaccgaattcaggttttaccaaacctttttcttccaagaacgtttttgtttcattgatttttgcaagtaaactcatattttctccttttataaataatccgaccagtcatattctggcattttttctttaatgatttcaagcggacgacagaggaaggctgtctgctctcgctcgataatggggcgattgagagtggcaggctctttaactaaacgctcaaagatttcttcttctgacaaggctagtcgttcttcttccttcaatcgaataactgctgaaggttgactgcccattttttccaagagagctgtcaattcagttccccttaatggtgtttccaaataattaacccacttgacttccatatcctggctggacagcaatattcttaattttttacacttgctacagttaggattgtaatagaccgttagcttctccattaaaccaattgtgacaagaagctttcgccaatcatggctgtgtccactccgaagttttccgcaacggttgctgaaatgtccgcaaaatggcctactggcaaaacaccgctacctttgaaagccttgctgtatgctaagagtggcacatattcgcgtgtgtgatctgttccagcataggatggatcattgccgtggtctgcagtaatcaagagcaggtcatcttcacgcatattgtcaataatctctggaatacgtgcatcaaactcttgcaaacaatcgcggtagccttcgatattgcgacggtgaccatacacagcatcaaagtcaactaagtttgtgaaggagaaaccttcctcgaagtctgataacttcagagtatcaatcaacacatcgacaccgtgcatgttggacttggtgtgacccatatcatttgtaatacctgaaccattgaaaatatcactgattttaccaactgagtaagttggtacacccgcatctgccagtttgttgagtactgttgcctcaaaaggtgatactgcatagtcgtgacggttggcagttcgtgagaaattgcctggctcaccaacgtatggacgggcaataatccgaccaagaagagctgggcgttcaagggtaatggagcgagcgtattcacagatacgatacaattcatccagcggaataatgtcttcgtgggctgcaatctgaaggactgggtctgcggaggtatagacaattaactccccagtttccatttggcgagggccaaagtcatcaatgacagctgtacctgaatacggcttgtttgcttcgcggatgattttacgacctgagaattcttcgatttttgtcaaaatctcttcagggaaaccatcccagaatgtatcaaatggctcagtaatattgagacccataatttcccagtgtccagtcatggtatccttaccaagcgatacttcttccaacttggtcacgtaaccagttggatggctttcagcaggaactgtcgcaagcgctgtatctcgagggatatttccaagaccaatcttggtcatattaggcacctcaagcccagctttttcagaaatgtggccgagagtgtcagattctgtatctgctacacccgcattgaaaaatttatctgagtctggtgctgcgccgattccgacagagtccataactaccaagtgaacacgtttaaatttaggcataattgtctcctttatttgatatagttagattcaaccaaaatcagcgtccaaccaagttgctagactggaaattatcatcaccacacctaaacattttaatggggtgcaatacttatacagtcaaagctctcggcatcaaacttcttaaccatcaaaactagatactgttactcgcttcactgcctgctgttcagctatcgctttttcagtacctatcatctgactgctacgaggtaaggggatagatttttgaagagtctaaacgttcgtgttttcattataccataaaaacgcctctcattgtaccaaaatgagaagcgttttcaatttatttcttttcgatgatgttcggtccttctggtgtaccaacaattaccttggaaatcaatccaataaagagaccgtgttctacaacaccgacggtccgatccaattcttccgccaatgcatatgtgtcttctattctgcgcaaatcaaggtcaatgataaagttctgcatatccgtgatatgtttttttccattacgcatacgaaaacttggacgatacccttttttctcaaatagtcggaaaagattttccgcaccgtactgcacgacttccaccggcaacttgaaggctcctagggtttgaaccatcttagactcatccacaatccagatgcagtccttgctattgactgctaccactttctccatgagaagcgctgcaccaccgcctttaatcccattgaagtcaccatcaacctcatctgctccatccaccgtcaagtccacatattcgacttcgtcgatattttttaggggaatcccaagggacgcagcgtgctcagccgtggcatgagaggtcgttacgcctgttatctgtagcccttcttctgcaacccggcggccaatctcctgcacgaaatagtatgccgtcgaaccagttcccagcccaacaatcatcccgtccgtcacaaattccgccgccttaatcccaacctgctcttttaggtttatcatctttgtctcctttgaagtaaaacgaatacatatagtatagcatggagagggagatgggacaagagtgagttagaaattcaaaaaataatgtcttaaatcctaaaaaatttttttcatttgttcaaatatatttgctactaacttagggacgtaggaaaccttatgagaagttagctgatgggacagtccaagaaattgaagtgccttatgatataccagagagctgggagtgggtgaggttgggtgctattgttactgctaaaggtggaaaaagaatacctaaagggtacaatctgcaagaagaagataatggtcatccatatcttcgagttacagatatgaaagatggtacgataaaaccaactaatataaaatttgctccagataatgtatatacaataataagaaattacactatttcgagtactgatatatatgtcacgatagctggaactattggtgatgttggaatagttccggaaaattttaataatgctctattaaccgaaaatgcccttaaactgatgctgacagaaagtatcaataaaatgtttttggctcatctcttgaagtctccattagttcaaaaacaattcaaagaagtttataatcaagttgctcagcctaaactgtccattcgtagcacaaactcaacaattatccctctcccacccctagccgaacaaaaacgaattgttgcccaaattgagcgagccttggaacaagttgaagtctatgctgaaagttacaataaactccaagagttagatagagcttttccagataaactgaaaaaatctatcctccagtatgctatgcaaggaaaattagttgcacaagatccgaacgacgaacccgtcgaagtcttacttgaaatgattcgtgctgaaaagcaaaaactctatgaagaaggcaagctcaagaagaaagatttggcggaaataatggtcgaaaaaggagatgataactctccttatgggaagattccgagaaattggactcttctttctgtcaaagatattttttcaattacgacagggttatcttataagaaaacagatttagctatcatccaaagaggtgtgcggattattcgtgggggaaatatcgaacccttagcatataaattattagataatgactactatattgagtcaaaatatattacatcagaatctgtttacttgaagcgaaatcaactagtaaccccggtctcttcatcgttagaacatatcggaaaattcgccagaattgataaaaattattcagatacagtagctggaggatttgtatttcaactaacaccatttatctcgtcagatactttatcaaactatctattactttgtctctcatcgccacttttttacaaacaactacaatcagtaaccaagctgtctggacaggctttatataatattccaaaaacaaagttgaatgatctccgtattgccttagctcctgaacaagagcaagaacgtatcagtaataaagttgggcaactttttcaaaaagtaaatctactttagttacaatatctttcatttctcgatagttagaaataggtatcaataatcctgaaatactagtactatttaacgtttttccttttatagcatcctttgaattaccagtggttgagattaggggcaaaaatcgcatcagatagtctcttatgatattttctttatctccgtacggaaatattgagattatcgcttcattatggctagcagggacctctaatgctactttaccaatagttaacttaaaactcatcaacaaggtgcctgccgaagctatctttaccttcttctgattaatagcaaaatctgatagatattcttttgttttgaagatgtgaccattgttagacatatctgaaatagatacccaaggaatatcgtctccccaataattcggctcacttcttggaggtgtttttccaatattaaataaaactagaccaccaaacttaacgtagcaccaagaactaggaagtttaaacaaagttgaattactaaaaccaatattttccttgttcttcccataaggagagttatcatctcctttttcgaccattatttccgccaaatctttcttcttgagcttgccttcttcatagagtttttgcttttcagcacgaatcatttcaagtaagacttcgacgggttcgtcgttcggatcttgtgcaactaattttccttgcatagcatactggaggatagattttttcagtttatctggaaaagctctatctaactcttggagtttattgtaactttcagcatagacttcaacttgttccaaggctcgctcgatgtgagcaacaatccgtttttgttcggcaagcgggggaagggggagaagtgtatctccaaaacctgaagcagaaatctccttaaatgtcgtacctgatgatcgtagaataatatcttttgttcgaaattgcaaaatccaatacataaaatctaaatttactagtattggcgttacggatttacaaccttgatttgtagtaaagtcatagttaacaatgtttatatgtcctattggagctcgactagaataaacaatagagttttttgaaattagttgagcagaagatttttgtacgcctaattcggtaattttttttgatgaggtggcaaataatttattgttttgctgtttacccatatctgcaggagttatccaagtgatattcccatcataataagtagattcagaagatttcggtgtgcctcccgaagtaataactcctaaatttcttaacctcacccactcccaactatctggaatttcataaggtacttcaacttttttaacagtcccatcagctaacttctcataaggtttcccatcatcactacgaaaaaattctgtttcctttttatctcgcttgacttttccttccgaaatcaacttctctttctcttccttgatacgtttcaaaagttcacttgcaggctcatcatttgggtcttgcggaacaagcttaccctccatcgctctttgcaggatacttgctttcagttgttcaggagtcattatttctcctccaaaatttctaaaatttccgccaaaacagtatcaatttttttatttaggacagctcgttcttgctgatagttttggataagttcaagtggctctaaaatttcttcctcttcctttggaaaaccgcattgatcaaaattatagtttaaactagctaactcatctggtctaaacgatttagatttgtagaaattcccttctaaaatctcttgtcgatttttccaccattcgcgaacaggattaaagtgatcgtttctcattggtttagttttagagaaatttttatagccttctggcatatccaatctgtaaaaccaagtttcttctgtttttttcgtcttatcaaaaaagagaatattcgtatgaattcctgtatatggagcaaatacgctatgtggtaagcgaataatagtgtgaagattaaactcctcaaccaatttctgctttagtcgtgtttttactccttcaccaaagaggaatccatctggtagaattacaccaacacgaccattttctttaagtcgatacataataacagccataaacaaatctgctgtttcagagctgcgtaactctgctggaaaattattttttattgtttcaagttcagaaccaccaaatggaggattcatcatgatgatatcgaacttttcatcctcagtgtaatccctcacatttttttccaacgtattcccgtggatgattttcggatcatcaatttcatgcaagaataaatttgtcaccgctaataggtgggggaaagcctttttctcaataccaaaaactgcttgattgtatttttgaacgtcttcgctagtctttcgctgttggcctaaatgatttaaggtagatgtcaagaaaccacctgtcccacatgctaaatctgccatcgtttcccctaattgaggattgagcatttcagcaataaaatctgttgctgcacgtggtgtgtaaaattcaccagaatttcctgcactttgaatatctttgagaatcttctcataaatatcattaaatgagtgacgatcttctggactgttaaaatcaacttcgtcaatcacattaatcatttgccgcagaagaactccatttttcatatagttgttagcatcttcaaaagcagattttacaattgatttgcgaattggcatgtttggagtgatttcgagttctttcaactctttgaacaatttattattcacaaactcaagtaagtcatctccagtcaagacctgctcacccttctcagcatgagcccagtttcgccacttcaactcctcgggaataattgactcgtattcttcttcctccaactcccaatctaactctcgactgtcatagatttttaaaaatagcatccaagacatttgttcaattctctgggcatcaccatttatccctgcatcgtttcgagtaatatcttgtattcgtttaacaaatgatgtaattgacattttttcctctcattaagctacagcaaatagcttttcttctaattctttaattacttctaagtaatgttttctatttccaaaataggtattaacaatcttggaaggagtaccataaacatgaaattctggtaactttaaagtttcgatactttcaagctcaccgattcccttatccatatacttatctagtaaaacctctaatacagcacgcgcttcttcgctgtatttaaatagatatccactttgtttcacatttctgattcgctcggttttagtcaaacttttctgcccgtatgccagtttcaaaagtaaatcaaaatcatcgatttcttgctccgaaatattttctgcttcacgaattgcatccagatatacaccttttttatagagttcttctaaaataacttttttcttatctgctgaatgccatgcagtaataaaatcggttaatgtcgcatatgttcctaaaatatttttacgtgtataatctgttagactctcagttactaatttcccattttcatccaagacttgaactgtcgaattgagaatatccactttcctatccgcaactcgatatttttctataggatcacctactgtaaatgatgttgaatcctgtccagttttcagattaggatctaatattttcgccggctcaccatcaaatccaggatcagcaaatagatttgtcacattcctaaaatcaataatagtgaaaaactctttccctttttcaggatataaacgtgttccacgaccaataatctgtttaaattctgtcattgattgaatatttgaatctaatacaatcaatcgacaagtttttgcattaacacctgtggttaaaagtttagaagttgtcacaatcgccggaaacttagagttaacatccataaaattatctagttgggcttttccttcaggattgtcacctgtcacctgcataacataacgatagtcctcccgtaccaaatcctgattttcgttgacaaatgcttcacgcatacgttcggcatgatcaatatcaacacaaaatacaattgttttgtcaaagcgtgcattattttgtttcatataatctgaaacaaattttgcaacctttcgtgtacgatcatcaatgataattgtcttatcaaaatccttgcgaccataatacctatcttcgataagctgtcccttagcatcaacttttccattttccggacgatagccatctacgtccacatctagattgactcgcataactcgatatggagcgagaaatccatcctctatcccttgcttcaggctataagtataaattggctcaccaaaatactccatattggaaacttctttagtttcttttggtgtcgcagtcataccaatttgcgttgccgatgaaaaatactcaatcactttacgccaattactatcttcttttgctgaacctctatgagcttcatcaatcactatcaaatcaaagaaatttttatcaaatttttgatagtgagtttcggttccatcttctcccattaattgctgataaagacctaagtatatttcaaaagaatttaatttttctggcgcattcagcaattttgatgtgattttagtcatcactttttcaaatggcttgaaatcttctgccattgtttggtcaactaaaatattcctgtctgctaaaaacaagacacgctttgctaatccggctttcctaagtcggtgaataatttgaaaagccataaaggtttttccagtacctgttgccattacaaacatgactctgttttgcccgcttgcaactgcctcaattgtacgattaattgcaatttgctgataatagcgtggtttcttaatcgaaaaagcatctgtatagtaaggagttgttattgctttcgaaacctctggtgccatttctttttcagcctttaatcgctcaaataattcatcacgggttggaaactcttctaaagagagttccctctcttgtctagtaattcggtcatgctcaacaaacccatcaccatttgaggaataaacgaaaggaacatccaaaatttcaccatattcaatcgcttgttgtaaacctgcacgaatactatgcttattatccttagcttcaacgattgcaattcgctgtccaaattgataatagagagcgtaatctgatttttttccctcttttcgacgtcctttatcacctcgaacttctattcgaccatctgtgaaatattcttcataagcaatctgttctccatttttccagccttttgacaaaatagctggtgtaataaagtttgctttaatgtcttcttcactcatctcttttttagatttgataaatacaaccataattttcctctttcagtatgaataataacttcaggataataagattatcagaacaaactatatttctattataccacacctaaataatcaaactacaatattataataaagtaattctcaaagtaaacataaatatatttacatccccatccctcatctgtgcttttttcatcattccatgatacactaatagataagacaattttagaaagaaagatatatgattaccaaagaattcgacaccattgccgctatttccacccctctcggtgagggcgctatcgggattgtccgcctatctgggacggacgcttttgccattgccagcacggttttcaagggcaaggacttggcgactgtacccagccacagcctcaactacggtcatgccattgatcctgcaacgggtcaagtgctggacgaggttatgattggagccatgcgttctccaaagaccttcacccgcgaagatgtcatcgagattaacacccacggaggcatcgccgttaccaacgaaatcctccagctcctcattcgccaaggggctcgaatggctgagccgggtgaatttaccaagcgggcctttctcaatggtcgtgtggatttgacccaggccgaagccgtcatggatgttatccgcgctaagaccgacaaggccatgcataatgccgtccgccagcttgacggctccctctcccagctcatcaacgacacgcgccaggagattctcaacacactggctcaggtcgaggtcaacatcgactaccccgagtacgacgacgtcgaggaggcgacgacagagctggtccgtgagaagaccctccagttccaagctcttttggaaaatctcctccgcactgcccgccgtggaaaaatcctgcgtgaaggcatcgcaaccgctattatcggtcgtccaaatgtgggaaaatccagcctgctcaataacctcctccgcgaggaaaaagccatcgttacagacatcgcaggaacaacccgtgacgttatcgaagaatacgtcaacatcaagggcgtccccctcaagctgattgatacagcaggtatccgtgaaacagacgacatcgttgaaaaaattggtgtggaacggtccaaaaaagctcttgaggaggccgacctgatcctgctagtcctcaacgcatctgagcccctgaccgagcaagaccgcaatctcctagccatttccgatatggccaaccgcatcgtcctgctcaacaagaccgacctggaagagcagattgaagtagaccaactgcctgaggatgtcattcgcatttccgtcttgcaaaaccagaacatcgatcagattgaagaaaaaatcaatcaactcttctttgaaaatgctggtctggtagagcaagatgccacctacctctccaattctcgtcatatttccctcattgagcaagccgttcaaagcctacatgctgtcaatgacggactgaaagtgggcatgccagtagacttgttacaggttgacctgacacgctgttggcaaattttgggagaaataacaggtgatgctgctccagatgaactcattacccaactctttagccaattctgtcttggaaaataagaacaaaagtcatgtaagaaaacttgcatgactttatttgtatattaacacataatttcttgtctaagatgacaaatttagatatactaaacagtgaaaggcggcattcccatgaaaaaacttcttatttgtattgtccttctatcctgtcttgtctttccatttatcggctggaaactatatgcctatcagcacaatacgatcacattaacgtcggaagctgatttttacttgatttatcctggcaaggtcgagacttttcagctaaatgggcaagagcctcaactccttcatacacagaaaatgaattctcaagggtattttggctctggtgaaaattatgtcatagacaatcggtatctagtctttgccaacgatcagcaaaaattcattaacgacaatctgatatccatcgatttcaatactggcactgtcttgcgaaagccaagtcagtatagtagctatatcagtggtacagatggacaagacttttatacagtggggccctatcacatactagcgcaatttgacaggaattttgatactattcaaacccacgttttaaacgatgacttcatcccaagtgctccagtcatggtagaccaaacgtcagtctatttaactggttttgtgaaagattttacccaagaaggacccgaagaaaatgtcttgattgtatttgataagaaagatttttcaaaacaagaggtattcaagtacgacaataccattgccacaggagaagggctttgggtcaatggaaccatctatctcccaaatttagggaaaaaaacaagtgagtatacggaaattgaacagtcatccgaactcctaacctttgatacaaaaacaaaaacattttcgtcagtaactttagaacacccctcaccaagcacactacatgctctcaaagaccagaagcttctcctcatcgaacatcaaaatggtatgtttagcccgatctcatttaccatttataatacccaaacaggtcaagagagctaccatcgtctagacgagcttaatcctcgtccttattatattgaccatgtccgccaactagacggtaacagattattattgattctggctggtaaggcactcatctatgactggcaagcaaaaaaagttttaagccaaactattctatctgaggattatgttagcggggtgtgggtaaatgactgataaacaaaaacgaatctcaataaagattgtaaaagtcccaagatgactctttcttgggactttcgcatattctatcgaagttgcacagcacaatcaatgtacttataaatcctaggaaccactatctaatcgaagtaaacgccattcccaaagcagaaccaaaataatatttccacctttcttgctctaaatagcgcttaaacatctttaatttatccgattgaatcctattcaaagctagttcttccaatacccatggataaattttatacgaaagatagctaatcttactacctttttcacacaactccattgcttccaacaactggaatttcaatgctttgctcaactttaattctgaatcagataatagttcatttattttttgtataaacaacttactttttttactgtttctaaacattttcatcttcgtagggatttctgaaacaatcatgcgatggaaatgatggtgcaaacctactcagtcacccatctcttccaactgcttattatttttctttgtccccttccacttcttttgtttcttgggcagtcagtaaacctgttgacatggcacgaccagttagggttgcgctgattaaatcacggacattgagtcctagaccttctgttgtcttgtccatggtcgtcatcaggtctcccaccatttttgaggcattcccttcgccgtacatggtaatcttatcaacatttccaagtggtgctgcaatattcttggcgatttctggaagaacattaaccaccatttctgtcaccgctgcatcattaaacttagccatggcatccgccttcttgctgagtccttctgcctcggcttcgagtttcaaacggatggcttctgcttcggcacgtcctttggcctcaatacctgccgcttcttgctccgcagcatacttggcagcttctgcacgcgctttttgagcttccgcttcacgctgcgtttcgtagagttctgcttctgccttgcgttgacgttcaatcaaatctgcttctgcagcttgttggcgagcgtatttttctgcctctgcctgtttgcggatagtagctgagagctcttgttcacggaccttaacttcctctgcttttacttctgcttctttttgttgcttgacaatattggcttcagcagttgcacgctcgatttctttccgttgagcttgctcctcaatgccataggctgcgtttgcctgtgccagttggacatcggaccgacgttttagattagcttgctcaatagctagttcattctgtttcttggcgatttctaagtctgcagcaacacgcgcatcattagccgccttatcctcacgggcacggacttctgcttgttcccgctctgctttggcgcgagcatttgcggcatccttctggatggtcacaatattgtcaatacccaagtttttaatgacatcgttgtcatctgtgaaggattgaaccgtaaaggcaatgatttccagccccattttagccaagtcaggagctgcgttggattggactttttctgcaaaagcctggcggttattgaccatgtctcgcagttccatctgaccaatgatttcacgcagatttccttccaagacatcttgaatagaggcagaaatatctgcagttttccagttaaggaagttttgagctgccgcattgagcaattcatcggataccccaacctttacttttacgaccgcgtcagcttttacgttgataaaatcaagagtcggcacaaaatctgtggtctgcacatctgttgaaaactgctcaatagagatataggagcgtttttcgataaagggaatcataaaaccagaacgaccaattaaggtccgaggtttgcccaagccggtaatgacaatcgcttcgttaggcttagcagacacataaccaaatacaaacaataaaacaaatagtacaacaacaataattggtatcataattgccaatatatcaaatccaaagtccatatttatctcctttattccttatcactcaaatccacacttggcacggttgtcgccgcatcatttgttgcttggaagagctctactttttcatatccgaatagacctgcatagatggaggtcgggaaccgcttgatttttttattgtaggtagttgctaccgcattatagtctttacgggctaccagtatccgattttccgtaccttcaagctctgttatcaggtcagatacctgttggttggctgtcaattgaggataattctcagccactaccaacaatctagacactgccgaatccagctgactttgtgcctgattgtagtcgctggttcctacttgactggagccgattttagcacgcgcttctgcaatagcagtaaatatttcttcctcgtgttccatggcgcctttgacagctgcgactacattgggtatcaagtcatagcgacgttgcaactgtgtgtctacattggcttgcgcattttcaacctcagcataactgtcaactaagccattgtattgcccaactgctcccattcctaaaaacagcagagctaggactggaatgagaataaccaaccatctctttttcataagatttcctttctaactacgattaaacattcgtaaaaaagcaaacaactatcagaagccttatacgatgccttaccatccagaagaggctccgccaccgccgcctcctgaccaactacctccgccaaaactagacgatgaggaattagacgagtgatgattgtgatagtgatgatgatcatcaaccaacatccagagtagattgcctggacctccaccaccacgactagatttgtcaatgataccaaataggatagcgatcagaataactatgagaaacagccagaagccgtcatccttctcacttgtaccttcttctatagcagctaactgatttttaccaatgcttgtaccataaaatctatccccaatggagttgacgatataggaaattcctctactgtagtcttcctgtcgaaagaattcccttgcattctctaaaatatccttggcttccacatctgtcaacaccgttgcagcattgtctgaggtttctatccgaaatgctctgtcagctatggcaaccactaaaagaactccgttgtccgttcttgcaaaaccgacctgccagtgacgaaaggtttcattagccaaactttcaatatcactggacagactttctgttacataaacaccaacctgtaaagcttgctcggtgcttgcccaacttcgattgagttgatcaatttctgcaatggtctcactcgagagtaactgcgtctcatccactaccgttgtacctgtggggcggtctgggatctgatttgctctagctagtgtgggtgcaaatagcaagcaaaccgttagaatagcgaaacagccgatgataatttttttccattttctcatcagaacacctccttcgatgaacaaagataagaaaaatttattaggtatatatatacaattatatcatattatcattttcccaacaatatatttatgttgtttttcagtatcggtagagtctgttcaacaaaccaaggatgtttagcttgccagatattgtttctaggtgatggatggggcaaaggaaaataggtgggtaggtaatcatctgcatgtttcactctctccgtcaggttcctttgggatttttccaaataataagtttgagcataattgcctaccaatatggtcagctcaatctgggggagttgcttcataatgagtgggtgccatttgggcgcaaaatccttgcgaggcggcaaatccccagacttcccttttcctggataatagaaatccataggaagaatggcaaaatgacccgattcataaaaagtctgtcgatccacgcccaaccattgacgaaggttgctaccactggcgtcgtcaaataaacgccctttttcctgggttttcaagccaggtgcctgtccaataatgagaatttttgcggtcgaaggggcttggaaaaggggagctattcccttgttcgtaaaatctcggttagcaacatcctcaatgatggcttgacgaatatcagcaagttccatgatgtcctactttcttgactatggtcacatcttcttctaaggctcggaaaacgcattttttgtagaaagaataggctaaaaggttgcgttcggtttgcagaagaatatgaacaatctttctatcagctaactgcttctcaatatcagctaataaactagcaccatgtccttgcccttggtaatcacgggaaatacagaactcttcaattcgatactctgttccctcataccaatagcgaatgtaaccaagtgacagccctatcaatttttcttggtcaaacaagccaaaacagagtgctcttgagtgtcccagtaaatcgcctatgtagcaatctaattgttcctcatctgaccaatcatcattccaaggttcttggctgaaaacagataaaaataattctttaaccatttccatgtctgaaaaataaagttctttcagttccatatttcctcctaaaaaagacgggcgtacccgtcttcatgtattacttaatgagttcgtagatagcttctgcataaatggcagcggcgcggtagagttgctcaacttcgataaattcgttggcttggtgcatggtgttgacatcgcctgggaacatagctccgtaggcaaccccgcgtttgagcaagcgtccgaatgtaccacctccgataacttgttcgtgacctttcaagcctgtgtgtttttcataaacagacaagagggttgcgaccattgggtcatcgattgggcaataatgtggagtatggccatgctcagacaggctaacagcttccacgcccagtttttccaaaccagccttgatggtttcagggttggtattttttggataacggaagttgagggcaatggtattgtctgatgaagtttcgtcaaatttgaaaacaccagcgttcatagaaagagctcccatttgctcatcgtagatggctacgccgagttttttagcgtcatggtcttccagaaggacttgacctgccaaatccaaataggctttggctgcttcgtcaaaggcgaattggctgaggaattttgccaagtaggttgctccgttgaccccttcttctggggttgaaccgtgggctgattttccgatgacggtgacttgaacttgaccgttttcaagggtttccgcatcagcttttatgccataggctgctgtgaaatctactaacttgctgtccagatctgctaggtcgccagagataatagctgtcgcagattcaggcaccatgttctcacgcaggccgcctgtgaaggaatgcagtttagcagctccgctattttcccccgcaaaatgaagataagctgtgatattgcccttttctccgttgataatcgggaactcagcgtctggagagaatccgaaatctggcaggggaaggccgacgtgctcgaagtagtaatccatgtccgcccagcctgactcttcgtcggtaccgacgatgaagcggacttttttagaggtcgaaaggcccaactccttgatgattttcaagccgtagtagcaagccatggtcggtcccttgtcgtcagaagatccgcgggcaaagagcttgccgtcaatgatttgcggctcgtatggatcagtgttccaaccgcttcctgctggcaccacgtccaagtgaccgaagataccgaggacttcgtcaccctcgccaaattcaaagtgacctgcgtagttgtcaacgttcttggttggataaccatcacgctgagcaatttctagaaacttatccaaggcacgcactggtccaggtccaaatgggtgttgggcatctgcctggctatcgtcacgctcagaattgatgcggaggaggtcaaagaggtccgctagaaactcatctttgcgtttgtcaaactctgctctaaaatttactgtcatatgttctccttttcagtatcaaagtaagtctattttatcacaaaatgaaagagatttcacaagtaaagcgaagaaaaaaagttggtctcccaacttctttctattttttccaagcagatcgttctgctacaactgtaaacaaaacatcagttgatgagttgagggctgcttcacaagagtcctgaatcactccgaccacaaatccgactccaactacttgcatggctaactcatttggaataccaaaaagactacatgctactgggatgaggagaagcgaaccacctgctaccccagatgctcctgctgctgatagtgatgcaacaacggataaaagaagagctgagctgaaatcaacactaatgccaagtgtatgaacagctgccattgttaaaatattaatcgtaatagccgcgccagccatattaattgtggcaccgagcggaatggatactgagtatgtatctggatccactcctaaacgtttgcagagctgcatattgacagggatattagctgctgaacttcttgtaaaaaatgccgtaaccccactaactcgaagacattcaaataccagcgggtacggatttttcttcattacaagaaaagcaatcaagggattgacaacaagcgcgacaaaaatcatgcttccaaccaagagtaagagcagtaaaccatagtcttttaaagctgtcagaccattatttgcaatggtatcgaaaaccaagcccatgataccaaatggtgccagaccaataatccatcctacaactttagaaatcacttccgccgtagattgcaataaatcttttgttgtcttgcttgcatgacgaaaggccaagccaaacactgccgcccatgtcaaaacaccaatataattagccgttgcaagagcattgattggattgtcaacgaccttcaacaagaggtcttggaatacttcagcaatcccttgtggaggagtaatgtccgtagtcgttgtagtagaaagaaccagtttaatagggaataaatagcttgctcctacagcaatgaaggccgccgcaaaagtgccaaatagatacaagcaaataactgtcctcatattcgatttttgaccagcaggagcttgtgatagagcatgtgcaactagtgtcagaaccaaaagaggggctatagctttcaatgctcctacaaatagactaccaaagagagcaatgaccgttattttgggagcaattaagcctagtaacactcccaaaacaacaccaattccgatttttcggattaaattcatttttttccatacagatattattttattcactcatttacctccaaacaaacatttttcaatcatagcagaaaaatccagtcaggtcaatagccttggcttctaaaatctattttctgcatgatgcaatctatgtgtggcgcccatttttttacgaataaatatgcatctgtaatcaaaataaaatactttataagctttatctacttactgcccagacctcaacgatttacgcaatcattttgttacctaaacagctaactccactacttacttttatttcaaatgatagctaggtaacactgacctgtaatttttctttatgtgcgaaaaatgtgttaggattgcaatgaaaagccctgccttatcagtaaagcaggactttgatggctcaagaatatcgctagtaaatatcaatatttttgataccattcttatcaaataattgtgttttcatctccgtagtcaacggagtaataacgatttttgaattagaatcaatattggatacgacaccgataatgcgaccgtctacaacgacaggtgacccggattgccccttaacacctgtgatattggtttgaagcaaaccgtcataacggacttccgtaatggttccatattcgtattcccaacgtccgtagagattaatgctgttgctgaccattagaaattgtcggccaactaggtcataggtgttacggtaaattcctagccgagcatttgccgtattggctgtctgtgtttttctgctaggggtggtgattttcacaagggctacgtctcgactagcatcccatgttccaccatatcatggcatctgaatgaagggattgaagggattggttctcttaatttctgacagttcatagtatggtgaagcatcgccccaaacagcatttccagaccaagtttggctggtcacacgtccagtcccatcatctgccactacgtgaactgcggttaataaagtattcggagctattagaatagctgaacttttttggtttgaccggaaccaacatttacttccaaataatgagataaattatatggataactattgcgtagagctggatctgaaacgtgagtcgtctgtgcttcaacctctactattgtaggaggagctaccgatagaccgacactaagaagggctacgccaagcagtaatttcgttttcatttgaaaacctcttgttttttctttcattatatcaatcctaattataaagtgcaagcgtttccaagtgttttttgttcaacaatttaggctcttctcatccattgacaatagctcaaaaataggaccagtgcttatctaactagccctgttaaaatactttctgtcagaagtatttgcctaccactttatcgataaattcgctaggtaatctgaggcaaattgagtcaagcgattgcgactgtctttggattcataaaaatcaatcatggcaaaaccagctcgtaattgcccagcaatctgttcttctaaggtgtggctaaattcatagccatattctggatcaatcgtaatttgtcctgcttcttctaattgtcgtgcgttgaaaggcaggctgtactttggaaccaaggttttgtctggatgctcccaaacatcatcagcatcaaagacataaatccaagggttcatataaccgaccatgagcagaccaccttttttcaaaacccgataagactcctgccacatattggccaaatcttcgatataaatatttgaaaccggacaaaagatgatgtcaaaactctcgtcttcaaaaggaaaggcttgtgtcatatctgcctggaccgtttgcaaatccagattttctcgctcagcaactagcctatccttgtccaactgttccttggagaagtccaaaatagttgtctcatagctatgagccgcagaaattggtccctgttgaccaccaccacaggccaaacccagcaatttcttacctttggctttttcaaaccagtcaagcggtactgtctttccaaccgtcaaagaaacggataagggcttatctttggcaacaagaaattcctcatgactgagcggaactgtataggcatttccctgtctagctgaaacccgattccaacgttcttgattgtagtttacataatctgtcatttttctttcctcgcttgaggcctagccaatatgacctcgttctgttcttttcatttttcacctcctttactatgctaattctattatggcataaagaaagagaaaaagctacctatcgatagcttttagtctacgtcaagtcgttaaaatcccagacatcgtccacccagccttcatagaaatcaggctcgtggcagaccatgagaattgagcccttataggcttgaagggcacgtttgagttcatccttggcatccacatccaagtggttagtcggctcgtcgagaaccaggacattgttttcacggttcataagcaaacagaagcgaactttggcctgctcaccacctgaaagaacttgaatttggctttcgatatgcttggaagtcagaccacaacgagccaaggctgcccgcacttctgcttgattgagggctggaaaggcatcccaaacgacttccagtggggtctgacgattgccgccagctacttcttgttcaaaataaccgagttccagatactccccacgctccacagagccaccgagcggtggaataatccccagcaaacttttaagaagagtagatttaccgataccgttggcaccgacaatggcaatcttctggttgcgttcaaaggtcagattgagcggcttacgggtcaggacacggtcgtaaccaatctccaagtcagtcgtctggaagataaagcggcttggcgtccgagccattttgaaatcaaatgatggctttggtttctctgcttgaagttcaataatctccatcttgtccaatttcttctgacgggacatggccatgtttcgtgtcgcaactcgggccttattacggttaacgaagtcctgcaagtctgcgatttccttctgctggcgctcataggccgcctccaactgagcccgcttcatagcatgtacttcttggaattggtagtaatcccctgtgtaacgggttaagagttgattttccacatggtagacaatgtttatcacatcattcaggaaaggaatgtcatgcgaaatcaagacaaaggcattttcatagttctgcaagtagcgtttgagccagtcaatatgctctgcatccaagtagttggtcggctcatccagaagcaagatgtcaggcttttccaagagcaattttgcaagaagaactttagtccgttgtccccctgataactccgtaacatccttgtccatgccataatccatgacaccaagcgcacgcgccacttcgtcaatcttggcatcaagcgtatagaaatcacggctttccagacggtcttgcagctcaccaacctcttccatgagggcatccatatcggcaccctcttctgccatagacatgtaaatgtcattgatacgagcttctgtcttgaagagttcatcgaatgctgtccgcaagacatcacggactgattgacccttttctagtttagcatgctggtctaaataacctgccgttacataacgtgaccattcaaccttaccttcatctggctgcaattgacctgtcacgatggacatgaaggtcgatttcccttcaccatttgcaccgacaagtccgatatgttcccctttcaagagacggaaggagacattttcaaaaattgcgcggtcaccaaacccatgacttaaattctttacttctaaaatactcataatttcctcacaacatcaaagaactggagtaaccaaactccagtttttacttttattctcgcagtattgagcggaacttcttcgcctatcagctgtgaaattcctactcaaccttgcgggggttagacaacaaaatcaaactctacgagttactgatttctgtctaactcccaatttccgcacgaaccacatcggcaatggtgtccacgtagtaatcgacttcagcatccgttggcgcttctgccatgacacgcaagaggggctcagtaccacttgggcgaaccaagatacgaccgttgccagccatttctgcttccattttttcaatgatagctgcaatagcaggcacttccattgccttgtccttcatgctattttccacacgaatattgaccaatttttgtgggtaaatggtcacttctgctgccaattctgacaacttcttaccagtttctttcatgattttggtcaattgcacagcggtcaactggccgtcgcctgtggtgttataatccatcagaatcacatgtcctgactgctcaccaccgacattgtagccttccttgcgcatttcttcaaccacataacggtcaccaactgcggtcacagctttttcaatcccttcacggtccaaagccttatggaaaccaaggttagacataactgtggtcacaattgtatttttggccaatagacctcgatcagcaaggtatttaccaacgatgtacatgatgcggtcgccatctaccaaaacaccattttcatcgacggcaatcaagcggtcactgtcaccatcaaaggcaagtccaatttgactacctgtttctttgaccagttcttgcaatttttcaggatgagttgaaccaacaccctcattgatattcaaaccgtctggcttttcagccattactgtcaaatctgctcccaaatctacaaaaatttgacgtgcagatgttgcagcagcaccattagctgtatcaagtgcaactttcataccgtccaaatctgtaccagttgataccaagaattgctggtacttacgtagaccttctggatattctaccacatctcctaaaccttgagcagatgggcgtggcaatgtgtcttcctcagcgtcaagaagagcctcaatttccgcttccaatgcatcatccaatttgaaaccatcaccagcaaagaatttgataccgttatcttgcgctgggttatgacttgcagaaatcatgacacctgcacttgctttttcagttttgactaggtgggcaacacccggtgtcgccaaaactcccaatttatacacatgaatccctactgatagaagtcctgcaatcaaggcagcctctaacatttgacctgagatacgtgtgtcacgcgccacaaagacacgaggaacatctgtctcatgctggctaaggacataacctccaaaacgacccaatttgaatgctaattctggcgttaattctacgtttgcttctccacggactccgtccgtaccaaaatatttacccattttcataacctcttattttgtttttgtaagtataatttgcatatttgcttccgtctgagacagtacaactggcaagacattgccgtcgctatctacagcctgtaatttagctgtaccactataattctcagacagattgctcacatccatcgcaacagcttcgacccgatcaatcttagccattgtttcttcatccgttgtcactttaacggtatctacgttgactgaaaccttagacagactgtaaccttctgccaattgattactatagactcgacctgctactgggaatgccttgctaacttttttaccaatcttgacggtaatcgcatcaggtgctagtgtcgcactcactccagccggcaaattggtcaattgtagcttgacagtctgtgtcccatcactcaactctctcaaatccgcagtcacttgaaaagtccgagttgactcatctgattctctctgtaggagaacacgattagagccccttaattcaactgccaccgtcgaagaaaatccggaaataaaatacttgtttgtatcatattcaatctcaatcggtacattgctcagtgtgtgaacataggtttctgactccgtgttctgtgcagctgattctgaatttttatagttggtggttgttgcatagaaaaagagcaacaatgctagaaaaatagataaggctaagtgacctacagctttaaacttatcattcatgtttgccacctcctaatcgcttccagatggacttcttctctacattttcagaaataaaagtcgctcgcaactctgcttcaaactcatccaaagtcaaatcatgtttaaatatcccgtttcgtgcaatagagatactgccagtttcttcagaaacaataaatacaaacgcatcagatacctccgataagccaatggctgcacgatgtcgtgttccaaattcctttgaaattcctgcgctctctgacaggggcaaataagcacaagcaacagctaccttgtcttccttgacaattacagccccatcatgtagcggtgtattcgggatgaaaatatttattaacaattcctgagatatatccgcattgagtggaatccccgttgctctatattcttgcaatgtttgggcttgttctactgccacaagtgcaccaattttacgcggagacatataagcaaccgatttgagaaaagcaacaattaacttttcttctgcactcactgtatttgtcccaaaaatctgagttgttctaccgagtttttcaagcatagcgcgcaactctggtgcaaaaataactactgctgcaataaccccatacgtgattacttgattaatcagccaagcaatcgtctgcagaccgaataaactagctataatctgaacaataatgaagagaaaaacccctcgaatcaatgtcataattttagtacctgcaatagacttactaaaattataaatcaaataaacaactatactaatatcaattaggtgcaacagtgcggtccaaggactggctatcaaactcgaccaataccctgtatccagtaactggtttaggtttaacatatcattctcatactttctaactcatacatagtaatgtactcattataccatattttttccccttttctttagaaaatagtgaccttcctgttaaaaatattacagatttactgcaggaatatatcatgttccaacatactccattctagaaaatccccaacctttatgataaaatagtcccatgaaaataaatacagctttgggtattctagcaggaaaaagttcccagttcattttgaaaaaactaggacgtggtactaccctacctggaaaaattgccctcaaattcgataaacatattttagatagtttggctaaggattatgaagtcgttgttgtgacaggtactaacggaaagactctgaccaccgccctgacagttggtatcctccaagaagcctttggcgaaatcacgaccaataccagcggtgccaatatgatcacaggaattacggcaacctttttgtctgccaagaaaaataaaaacggcaagaagattgccgtcttggagattgacgaagcaagtcttgcccgtgtaaccgactttataaagcctagtctgattgtctttaccaatatcttccgtgaccagatggaccgctacggtgagatttataccacctaccagatgattttggacggggctgcaaaagctccgcaggcaactattttggccaatggtgatagtccacttttcaactcaacgaacgttatcaatccagtaaaatactacggttttgcgacggaagagcatgagccacgtctggcccattacaataccgaaggcgttctctgtcctcattgccaccagattatccagtacaagctcaatacctacgccaacttgggtagctacatctgtaccaactgtggctttagccgacctgaactggactacaagttgaccaaactaaaagaaatcaccaatacttcttctacctttgtcattgacggtcaggattataagattaacatcggaggcctctacaacatctacaatgccctagcagctgtcagcgtagcagaatttttcggcgtatctcctgaaaaaatcaaggcaggatttgacaaatcaaaggcagtcttcggtcgccaagaaacatttaagttgggtgataaagattgtacattggtcttgattaaaaaccctgtcggtgcaacccaggctattgaaatgatgaaactggctccatacgattttagcctgtccgtccttctcaatgccaactacgctgacggaattgataccagctggatttgggatgctgactttgaacaaatcacccaaatggacattccacaagtctttgcaggcggtgttcgttcgtctgaaattgcccgtcgcctccgtgtgactggctatcctgagaaccagattactgaaacaccaaaactagaagacatcatgaccttgattgagcaatcgagtagtcagcatgcttatattttagctacttatacagctatgctcgaattccgtgacctgctggctcaacgccaagccgttggaaaggagatgaaataatggtctatacgtcattaaaaagtcctgaaaaagactacacttacgatctccacatcgcccacctctacggtgatttgatgaacacctacggtgacaatggcaatatcctcatgcttaagtatgtggctgaaaagctgggggctcgtgtccaggtggacatcgtttccctgacagatgaatttgacaaaaatttctacgacatcgcctttttcggcggtggacaggactatgaacaatccattcttgctaaggatttaccgacaaaaaaagacagcctagcagactttatcgaaaacgatggcgtcatgctagctatctgcggtggcttccagttgctcggtcaatattatattgaagctggcggtcgcaagattgacggtctaggaatcatgggccactacaccctcaaccagaccaataaccgctacatcggtgacatcaaaattcacaatgatgagttcaacgaaacctactacggttttgaaaaccaccaagggcgtactttcctagctgacaaccaaaaaccgctgggcaaggttgtctacggcaatggcaataacaaggaagacggcggcgaaggtctgcactacaaaaacaccttcggtagctacttccacggaccaatcttatcccgcaatgccaacctggcctaccgcctggtcactactgccctccgcaaaaaatacggacaagacatccaacttgccagctacgccgacatcctcagcaaagaagtcgctgaagaatacggcgatgtaaaaagcaaggcagaatttgatactcaatgaaaatcagaatcagactaggcgacgcagatgcagatagaactgaagttcatcaaatcaagtcaacaacgtctgactttgattttcgaagagtatgagaaataaagcaaaaccgcttctgatatccagaggcggttttattttatatacttccaatcaaaagtaagccctccaccgttatctccgtcaattgactcaaatccagcttggactggtccacttggaaaaagaggggtgtcatgtctgccaaaatacgagcctgctctataccaatcggcagggtccggctgaccacctcttgctccacctgtcccatgtaagacttgaaatggtccacgatatcttggttgtcataggactccttgcggagttggtctttggctaaatggcggagctccttgaggtgattggggcctgggactagtttgagaatagccccaccagctttcagcactctggcaaattcctgataattggctggggagaagatgtccaagatcccgtcgatggtcttgtcttgaatgggcaacttggtcaagtcaccgacaaaccatttgaccgacttggtcctgtctgttctggctgctaggagaatagaatccttagaaatatcaaaagcaagaatgtccaagtccattttctcggctaatttacgggaataaaagccctctccacagccgatgtccaagacagaccgcaatcccagctctgctattttttcctccaaagcctcgtagagatgatcgtaatagcccgcctctaaaaaggcctgacggttttcaaagctagacttgtggtagttggcggactgcttgacctggggtgccaggttgacgtagccctgcttggcaatgtcgaaggtgtggcggttggggcagcgaaggctgttgaggtcaagaccaagagcctgcccacaatgtggacaggcgaaaaattggtcgctattggcaaaacgttggtgtttggtcatcttatttgtgttcttttctaaagcggtgcagggctagtcctgataggagcgtggcaagggctcctgtaaagaccagcaagtagccgactggaatgagataaaaattttcatgcagaatgccctcggcatcaatatactcgaccgagtttgccttgatgacaaagcagacgaagccgagaagcatgagaaaactaccaataatggtaatggtcaggtgcatctgggtacggcggccttcacgaccgtcttttacaagtttttctgtcatgttgttcatatcagttcctcctaagataagttgatctaaggagatcgaaaagacagaggacatgagaatcaagagctccaaatcaggtagattcttgtcattttcccagttggaaacagcctgcctggtcacattgagtttgagggcaaactgttcctgagtcaaacctttcttttttcgtaagtctttgatttgctgtccaaagttcatttctttctcctttctgggagcgggacagaactcgaaaaatgaaaaaaagttcgtcaacaatttttcgttttaagttgttgagctgaaacagtctatccccagactgtttcactcccacccccgcacagcttaaactgtctgggggacagtttaaggttgggaataaagcgaacaaagttcgcaacattcgttaggccagatttgaagtgtgcaacacgaacaaatctgccaatcaaccactgcgctgagatgttgacaccaccttcgagaagtgatgctaatctctatactgatcttagcttgtcggtcgatgttttccaagaaagactggcttgctctggacttttttagcgaaaagtggtcgttctaactccgcaagactggcttgcaagcttgttctatcaagggtttgagcctcttgtcaacttgctgtcaacctagcccatctgctcagataattcttcccattcttccatgagactttcttgttggctggtcagttggtcgatttctttctggtaatcggtcaactggccgatgtcgttggtttctagcatggcttggttgagctcgttcaggcggttttcgatgctatcgatttctgcctcgatttgctcgatgcggcgggctagtttgcgttgctctttttggttttccttttgggcttggtagtccatggctccagctgattggctggtactttctagctggtcaggctgggcttctgcttccagctctgcttttttctccaaataataatcatagtcgcccaaatagagcgtggagccagtttccgagatttccagcaccttggtggcgacgcggttgatgaaatagcggtcgtggctgacaaaaagcagggtgccgtcaaagtcgatgagggcattttccaagacctccttgctgtcgatatccaagtggttggtcggctcatcaaggatgaggaagttgttgttttccatggacagcttggcgaggagcagtcgggctttttccccacccgatagcatggaaacggactttttgacatcatctcctgagaaaaggaaagctccaaggcgattgcggatttccacttcaggtgtagtcggaaaggcggaccagagctcctctaagaccgtattggaaggtgtcagggccgactgggtctggtcatagtagcccacttccacattggcaccgagccaggcttcccctttgataaatggcagagctccgacgatggatttgagcagggttgtttttccgattccattcggaccgacaatggcaatggcatcgagtttccgttggtcaatagaaatgggctgggaaagaatgtttccatcgtaacccaccgcagcattttccactgtcaagacgatattgccagaagtcttgtccgactggaaggtcatattggcagacttctgaccagttgtcggcttgtccaatcgatccatcttttccaactgcttgcgtctagcctgagcgcgcttggtggtcgaagcacggacaatatttttctggacaaagtcttctagtttggcaatttccttctgctgcttttcatagttttgcaattctgtttgtaacttctgctctttgagctcaacaaactgagaataattgcccacatagcgatccaaggaatgcttggtcaaatccagtgtcagtgtcgccaccttgtccaagaaatagcggtcatggctgacaataatcaaagctcccttgtaatgcactaggtagttttccagccaagcaatcgtgtcgatgtctaggtggttggtcggctcgtccaggaccaataactctgggctttcaagaagcatttttgccagagcaagtcgagtattctgaccacctgagagttcggagatcttcatgtcccacatggtctggtcaaacttgaaaccattcaaaatagcacggatgtctgcctcatagctaaaaccacctgccagacgaaattcctccgacagactatcataggtcttcatgagctggtcgagttcattaccagaaagactgcccatttgctcttccatagatcgcaggcgtttctccgtcatccgcagatcgtcaaagacatggagcatttcatcgtaaatggtattttccgactcaaaacagctgtcctgtgccaggtaagaaagggacaaatctcgcttggtagaaatctcgccgctagtcgctgcttcttctccgacaaggattttaagcaaggtggacttacctgccccattttttccgacaagagcaatccgatcccgctcatccacttgaatgttgatattgttaaataaaacttcgcccgcaaatgagcgttcaatcttgtttccacttaaaataatcataaaaatattgtaccataatttagggtaacagtgcggaatcctttttctgatttcagcaaaaaacagcgactttaccgtcactgtccttctcaaaaaatatttagaccaaaccgctaagcaattccttattctgccagagtagataaagaccaccgccgataataatcagcataatgacaaacttaatcaagcccttaacaaagcggatgaccaacatcaatatcatagatacaatcagccatccccaagcagaagaattgagtaaggtttgcatactctctagacttgcacctgtccaggccttaattggttcagggattttatcaaaccagttgctatctataccgatttgttccataatcgaatgactggtagactgcatccatgcaaaaattccagcattatagagaaagagcagagcttgctcaggataacgttttattgtgtttgtaattgttcgaagcatattttcccttctattctgaatacaaggcaaggaccgcatcaatatctgcctgctggataccatgattagaacctgccgattccataacagaggtctgactatcttcatgatctaggccaatagcatggcccaattcatgctcagctgtatggataattctatccatatcataaccatattggtcgtttaataaataaaaactattcagacacaccgttaccgagctataataattcgtcaataaattagtcgttgaattggcctcacctgctgcctgggtatttccatcattcatctcagtagcaataatatcagcctgatttggatcacttgtcatcacaaaagtaaatgcccctgtcgcattccaatttgcaatggctgtttcataggcagctacaaatgttggattctgagtttcaatgtaaacagtcgcagtattgctttcccatcgaccatgatcggctgtattgaccgtatcagtcgtcacttcagactgtcctttaaccatcagttgcacttcttgaggtagagtttgtaacatctgaggcgctgcttcctgttgaaaatagaataatagacctagaccacaagccaataacaccattgataaccaaatcagaccccaaaatgtccgccaaatccaccgtagaatatttccaataagtttcatagactatacctctttctagaaataggttttagtatagccataatttctgaaacttttcttaaaaactaggacaatctttcttccaatttgaaatcaattggcaaccaagccaatactttctcaatctgctgattccagtagtaccactcatgtttaccaggtccgaaacttgcctctatatcaaatcccagctctttcaactcctcaactgccttttgatgcccttcaaagagaaaatcttcctcaccacaccaggcataaaatttggtctttttatcggattgtttagcaatttctaacaaattatttggattctgtttatcagaaatatcaccaaatactccttgccaatacgaaagacttcccaattctgctgccgctggattatcaaaatcaaaatacaatgcgcctgaaagcgaagctgcgtgtgaaaagcgattggtcatcatggcaatcttgaaagtcccatatccccccatagacaaaccagcaatgaaattcttctcccgcttgtcagacatatttgggaaaaaccgcttgaggatttgaggcaactcaatcgctatggcatcataataattcataccataggtggtattggtgtaccaagccttatccgtattaaccataacaacaatcaaattagtataacgaaccaagcgttcaattgtagaccgattgagccaggaatcctggtttcctcccataccgtgcaaaagatataggacaggaatgtcgttgtcatcgggattttccacacgatttcgatctggatataaaaccgtaacctgtctagacatatctagagcttctgagtggtattcaattttcattattgccataaatcttctccttatggtaaagagcctgagtttccctcggctcttcttatgtatataaatcagcttacttgacttccataatcaccggcaaaatagctgggcgacgtttggtttggtcaaagaggaattttgctaaatcatcgcgaacagcactcttaagctctgcccagtcaaagctatcctttgtaaagtaattttccaccgttgtattcaccaattctgatgcctcacgcaagatgtccttgctctttttcacgtagacaaaaccacgagtattgaccttggctttagaaatgatttttttctcacggcggttgacagtgatagccacgataaagataccgtcttctgagaggatcttacggtcacgaaggacgatatttccaacatcgcccatggcatttccgtcaatcatgacatcaccagccggaaccgctccgctatggacaaaatccccctcttcaaaagccatgacatccccacgcttaacgatgataatgttttctggatacataccgatttcaagcgcagccttagcgtgagcatccaattgacgatactccccttgaactgggaaaagatatttaggcttcatgatgttgagcatgagctgcaaatcacgcgcattcccatgcccagagacgcgaagattctttgtgatagattttacggtaccaccagccttgtaaatcaagttctccacacgagcaacaaccgcttcttttgaaatacttggagtggtaacaatataaactagatcaccttctttgatttcaacatagcgatgtctaccgatagacattttacgcaatccatttaacggctcgcccatacgaccagtttctaaaataatcaattcatggtcttcatacttgttcatatcctttggttttaccaacaagcgttcgctgaccaaacgaagttttttcaattgaatcgctgttcggacaatgttttccacatcatgtcctgtcaatacgacacgacgaccagttgcttctgccgcgtcaaaaatctgttgaatacgtacaatattgctggcaactgctgccacaataacacgcccgtcacagtcagcaatcgtattgagaatttcctccccagcctcatgcatgctcgctacttgaacattgctatctgcattagctgagtctgacaagagggccaacacaccttcgttaccgatttcagccaatcgcccaaaatccgtacgataaaacttatctgccgcctggtcaaacttaaagtcacctgtgtagacaatatttccttcatccgtcttaacgacaattcctaaactctctggaatagagtgggtcgtctgaaagaaagataccactgaatccccgaaatcaatttccgtttcagcattgataacatggaaatcattaaatttcttagtagcattattccccttgacaagtagcttagccaattcgatagtcaagtgcgaaccaaatactggcactttcactttctccaagagataaggaagcgctccgatagcatctgcatgcccgtgagataaaaagacccctgctacacgatgcttattttcttccaaataatcgaaatttgggacgactacatccacacctaactgttcattctcaggatactttgcccctgcatccaaaacaaaaatatgttcattcacttcggcaatgtacaggttttttccattttcccgcacacccccaagagccataattttaattgtactcatctttactccttttggacatcccacaggtgtccattttatttttcttaccaacggtccttgggagctccaagtcgaattacagtctgctatttatcgtcatttagtttttcttttattacttcgacgtaagaggaaactccgtttccttatttctaacttcaaacactccactggactgtttgaactcgccttgcctgattgaaacagtctgggggactgtttcaagtcaatgcctagaaacaagaaaacattgagtcatgcctgcagctcgttgcctagtactaaaagtaaactaaaagactatattttagctatcgcttctattatacattttttcaagaaaatttacaaaaaactccgctgaaaatcaacgaagttctacatatacattagtaaccatgtcccttatgttcccacttaccaccaacattccgcactaaaatccatttccaatccgtatgagtactattaggctctaaggtgggctctgccccctcagctgctaccttaaaagacgaagttaggataatagcttcctctgcaccatagtgctccgcccactcatcaaattccttttcattatcaccactgtaaccgatagtcagcaatttacaactgttaaaatggtgatcaaagtaatcttgaactacaagaatagccgcctcaatctctttttccgtatacaattctgattgttccatcggttcaatctctgcctgataagctgctcctgtccgacatcctaccaaaaaaaggcaacacaacagactacaaatagctaaacattttctcatctttgttacccccagtcaacaatcgttgctgaaaagccaatctcttcgacaaaacgtaatacatcctccgttttgacaaaaattgttttcgtattaacattggggtggaaggttagaatgggttcggataggatttctttatcaaaaaagacttgaatatccttatcaacattatgtaacaagccaaaaacagataccgcacccgcaggcaagtgcattttttccatcaagctatcactcgaggccatccgaatgcggttggctcccaccaaatcacgaaattggtccatatccagctgcttctggtcatccatgatcagtaaataaaatgcagtctttttcttattagtcagaaacatggacttggtccgtactccttctaccccttcaatgtaacggtctgcttcctcagttgtcagagctggtggatgctctacaatggtgtagtccattcctaagtcagctaagctttcaaaaaccaatttatccatgacagcacctcttgatatatttagtatattatactgctttttaactaaaaattcaaaggataataaaagcctggattactccagactttagacctgtattcacaagtgatctgtttgatataagattcagttttagccaaaaccaaacttagttggaagttgcgaactatccacacaggttcttaatcaaacaacttataataatcttccagtttcatcttggatttttcttcagccgtttggtcctgaataatctgaccatttttcatgacaatcaagcgattaccgtgacgcagagcatcttccatctggtgagtgaccatgagggccgtcattcccttggtctcaatcaactcgtccgttaattgcatcaaggattggctggtcttagggtcaagggctgcagtatgctcatccaagagtaaaagttcaggctgtttcaaactcgccatcaacaaactcaatgcctgacgttgaccacctgataaaagtcctgctggcgtgtccagatgtttttctagaccatttcccactctcggcaaaagctgggcaaattcttccgtctgttgggccaatctgcgtggcagtaagccccgtccctcgccacggtacttagctatcagtagattttctgccaccgtcatccgtggcgctgtacccattttaggatcttggaaaacacgtgacaaatacttagcacgtttttctgcaggccaattggtcacgtcctcaccaagaatatggactgaaccactagtcaagggtagggttccagcaatgacattaaagagggttgacttcccagccccattgccacctaaaatggtaataaaatcaccctggtagatggtcagattgacattgtccaaaatcacacgttcttcatcaaaaccgtttgtcaccaccttggtggcattttttaattcaacaattgctttcatcgtgacagactggctcctttcagaagtttatttttcaactcaggaaccatgaggcaagttgccagaatcatggccgagaaaatacggaggtagctggtattgatcccgagggaaatgaccaccaaaattaagaactgatagaaaatcgctccgacaacaatggccaagaatcgttctaacatagtaaggttaccataaattacctcaccgataatcagactagccataccgaccacaatgactccaataccacgcgacacatccgcatagccttcttgttgtgcaatcaaggcacctgcaagagcgatgatcccatttgaaagaacaaggcctagcaactccattcgacttgtattgataccaaaactgcgtgccatatctggattatcccctgttgcaataaaggcctgtccaaggcgagtatagaggaagaacatcaaggcaccaatcaccaccgctaggctacctagacctagcaagagaccattgacttgctcagaaaaaggaaggaaatcttgtaaacgtttggtattcagtaagcctagatttgccctacccatgataaatagaatgacagagtgacaggaagacatgaccaagataccagctagaagagtgggaattttccccttggtataaagcaagcctgtgacaaagcccgccaaacagccaacaagaactgctgctagagtagccaagataggatgaactccttgcgtcaataaggtaacagcaaccgctcctccaagcgggaaagacccctctgtcgtcatatcaggaaaattcagaatccgaaaggtaacgaatattcccaaacctagtacagcccataaaagagcctgtgaaactgttgatacaatcatatttttccttttctcttatctcttattcgataaccttgcttgctttactaatcacatcatctgacaaggtaattcctaattctttagcaactttttggttgacaacaacggtaccctcgttaaagatttgtacaggtgtatccgctggattggcaccatcaagaattttcgcagccatcttaccagttgccacacccaagtcatattggctaagggtaacagatgcgatacctccaccttctaccatgtcttctacgctagtgaaaatcggagttttggttttatttgccacagatacgacagttgaaaatgctgaggcaactgtgttgtctactggtgtaaagagaacatctgctttactacttgcgacctctactgtcgctgcaatttcattactagaagcaactgcatattcaagaacagtatagccagcctcttctgctgctgccttaaattccgctacttgaatttttgaattgtcctcatttgaagaatagaggacaccgatagttttagcgtctggtgtaatttctttaatgagagaaactgcgtctgctactggtgtttggtcagatacccctgtaatatttccaccaggatttttcaaatccgtcaccaggttggctccgactggatctgttacagcccccatgataatgggtaattctgtggttgcattggcaagaccttgtgcagcaggtgttgcgataccaatcaataattcattgccattgtccaccaattttttactcatggtttgaacttgggattgatcaccctcagcattcataaaatcaatttctaaattatccgttgtggtataaccaccttcttcaagtcctgccttgattcccttataaatctcatctagtgaatcatgggttacaaactgaagaacccctatcttaactttctccgttgatgtagatgaattgttctgctctttctgtgtcataaacaaagcagcaactaccataacagtaagggcaacaattgtagcaagtaaatttttatttttcaacatattcattctcctcgtaaaatacacaatatacaatttctacgtcatcaatatattatcccaccatcgccatcgtttcatcatgattacctcgttttgttaataattgtcaaagtagattgcttttagataaggaacggaggcgcagacataactcaagttaggcaagccgaacgtgacgcaatataaaagcactctacgaagacaatggaaaagcccccgcaggaaaaaacaacctgcgagggcgtcaatgacacggtgccacctcacttatgggaattgtctagaatcctcccatatctcatctcctctaacaaggagttgcactgtaaggtgtgcggaccgaactatcattgttttaagttcatttacgtgactgttttggctagttacttcgttaactctccttgctataccgccagtataagctgcgtcgacctgcctcgtactcagccaaaacagtctacgcaaagtatgctataccaaacaatccttgtgaatttagggcattttaggactaggcagtcgggtgaaggcagtactggtggtacggcaagcacgactaacgacgtcataaaatagacataaatgcacatcagcccatttcataaaactccgccacccgttctcagcaccacaggctccctgaagacttctgctttactacttcttctgattacagatgattatacggtatccatcagtctttgtcaatacttttgattaaattttctgaaaactttttaataccttaagagtctattttgagctattgctcaggatactgccattggattgaataacttctttataccagtaaaatgatttctttctatatctagttagactgccacttccatcatcatttctatcaacataaattagtccatatcttttagataattgtgcggtagacatagatacacaatcaatacagccccaagaagtataacccatgacttctacgccatcctgtatcgcctccgcaacttgtaaaaggtgttcttgcatgtattgaattcgataatcgtcatgaacagtcaaaccaccagcctcatccttgactagctgatctttagctcccaaaccattttcaacaatgaataaaggaatctggtatcgattataataacgatttagtgtcaatcttaaaccaattggatcaatctgccaaccccaatcagaagcttctaaataaggattgaccaaaccacccaagatatttccttttccagatgaatattttgatggatctgctgcctgagtaatactcatataataactgaaggagagaaaatcaaccgtattattttttaataactcttcatcaccttccacgaaagtaatctttatgccattttctttaaagtatcttttggcataattaggataatatcctctaacatgtatatccgaaaataaatagttcaaattttcataggcatgagccgcccaaacatcttcaggattgggtgtcattggataggtcggcatagctaagaccatacagccaaccttacagtcaggaataatttcatgagcaattttggtaacaagactagaagctacaagttcatggtgaatggcctgatataaatcttgttttgaaagttcttcattcggcaagtcaattccaccacttgtaaaaggcaattctaagacagaattgacctcgttaaatgtcaaccagtacttaaccttatctttgtatcgctcaaaaactgtacgagcaaatttttcaaaaaattgaatcatttttctatccacccagccatgatatttccttgccagatacaggggagtttcatagtgagaaagagttacaagaggctctataccattctttagaagttcatcaaaaagttcatcataaaactgtagcccttcttcatttggaaattcttcatctccattcggaaatattctactccaagcaattgatgttctaaataccttaaatcccaactctgaaaacagggctatatcttccttgtatcgatggtaaaaatcaatagcttgtaatttcaaattatcctccgttggttcttgggtagcttcacccagtccaccattggggagaacatcttgaacggataatccttttcctccctcattatatgcaccttctacttggtttgcagctactgctcctccccataagaaattatctggaaaaattgacatataccctcctcgaattataagactgctaataaatcatcagcatagttgacttcctcttttgtcgaaagcaagagaacatccagatattcctgtgtatttgtaacaactacaggagtcactatatcgtacccttctgcgacaagcatttctacatccacttccagcatcagttgacccttttcaactttttccccatctgaaacatggcttacaaaacctcttccttttagctcgacagtttctaatccaaagtggataagcaactctaccccttcatcacttgttaaaccgattgcatgttttgttggaaaaagactggtaacagtcccgtcaaatggagcatagacttttccatccttagggataattgcaactccttctccaagcattttttttgaaaacgttgcatcatttactttttctaaagggagaatttgacctgaaagaggagagaagacattttttctacttgaaatgccaggtgctactttttctaaattaactgttgacgtttcttcatcaatacctaggaaataggccaaaataaatgtgacaataattgaaattgccgcagcaatcatagcattagtaatgtttgaagctgcttcagagtaaataaattgtggcaaagcaatgagagaaggtactgcaaagaggtatgcttttacacctgtcaaaccaacaaataatcctgctagaccaccaccaatcattgctgcatacaatggttttttatactttagagtaacaccatataaagcaggctcagtgacaccagcaaataaagctgaaaatccagctgcaaaggctatttgttttgtgttactatttttactcttaaatgcaactgcgatagaagcggcaccttgtgccaagttagaacctaacatcgctggtagaatcaatacatcaggtgtcgcgattgaagctgccaagaaaatcggtgcaaaagcccagtgcataccggtcataacgataaatggcatgattgctccaagaactgctaaagttaaccaaccagctacaccatgcatttgttcaaccaattgcgataatccttcaccaacaataacgccgagaggtccaacaagaactaaagctatgaaacctgaaacaagcaggaccaaggttggctgtaagaaacttttcgttacagctggagtgaccttgttaaaaacagcttcaatatacttcattagccaaaccataataagaattggaataactgatgaaccatagctagcaggtgtaacaggggcacctaaaaaatgaagtggatcacctgaagataccatttgaacaaaattaggatgtagcaaaataccagcaaccgacatagctaaagcaggtgtaactttgagtttttgtgaagctgagtaggccaaaaaaatcggcataaagtgatatggtgcatctccaaaaaaggctaaaaatgaaattgattgggaatccgcttttaaaagccccagcatcggtaagacaatgactagaacttttatcatacctccaccaagcatagctggaataagtggtgtcatagagccagcgatatactcgatgacttgttctaagacatttgcttttttaagctgttgaactgaatcagaatcaaattttcctaatgcagtaaattctttatagtaattagctacatcattacctaagatgatttgatattgtccattttttttcataatgccaatgactccggaaatggatttaacacgttcatcggacacgatattctcatctttcagttccagtcgcaatctagtaacgcaatgggttgcacgaagaacattcttttctcctccgactgcccctaggattgccaatgcagtattcttgtacttcataatagactccttatgataaattttttgttaaacgccgaatgtgagcaattaaatagactaattcacttggactcagtagataatcatattctaaccgaataaagtccgctactcgagttccacattggtactctcttggatacttctttttcattaactctaaaagatccacatcatcttcatcatggtattcattcccctctaccaaacgatgagcaaacaacttaacatgtgtgatgaatcggtagtaatcaatagaatcttgattgaattctgtagaataatagtcttgaataatttgttcaatcttcatgataattccagtaatacgataagattcttgaaaaatattttccaaattcgcattgacaaaatgcaaagcgatgaaggctgcttcatcaactgggagttcgacatgtaaatctttttttatgatggataatgcttttttccccagttcaaactcctctttataatatttggcaatttcccatctaagagggttcgtaacgactactccttccttatgtctttctatactagaattgatatgatctgtcaaattgatgtaaataatctcatcaaaatgatttccaagtgttatctttcctaaatttattattttctcacaaacataaaccaactcaataggaacatcgataaatagttccgtaaagcgattcatattatcgctattcttgagcaaaaaacttttttctatcgaagaaggtgggatcgcatctccgaccttctttccaaatgcaattcctttaccaaacaacaagatatcaacgttcttattattttgtgctatgactgcattatgatttaatacacgctttatgatcataaattttcctttaaacttaaaataaaagaacctacttaaaagaaatcgacatatatcgtatcgattcatttaaataggttcctgctcgccttaaagcgataacatccttttatttcaattattagttggtacttctagcttaaaaaatttaataactctgtaaccattttcaattttaatataaattaaagaatttgtcaataatttataaaaatataagaatacttcttttagtccccttcgttaaaaagtcactgatttatgatatactagactgagttatagctattagaaagaggaaaactatgtcttttgacggattttttttacatcacatgacggctgagttaagggccaatttagaaggtgggcggattcagaaaatcaaccagccctttgaacaagagattgtcctcaacatccgcagcaaccgtcagagccataaattgcttctgtccgcccattcggttttcggtcgggttcagctgacccagtcggactttaccaatccaaaagtgcccaatacctttaccatgattctgcggaaatacttgcagggagccattatcgaggagattcgtcagttggacaatgaccgtatcttagaattttcggtgtccaacaaggacgagattggcgaccatatccaagcaaccttgattgtggaaatcatgggcaagcacagcaatatcatcttggtagataagtctgaacagaagattattgaggctatcaagcacgttggtttctcgcaaaattcctaccgaaccatcttgccaggctccacctatattcgtccaccggagacgcattctctcaatccttatacggtgtctgacgagaaattgtttgaaatcttatcgactcaggaactgagtccaaaaaatctccaacaggtctttcaaggtttgggtcgggatacggcttctgaactggccaatcatttgcagatagaccgcctgaagaacttccgtgccttttttgaccaggcaactcagcctagcctgacagacaaatcctatgctgctctgccatttgccaatagccctgaaaaccagccacactttgagagcctgagcagtctgctggacttctactatcaggataaggcggagcgggatcgggtggcccagcaggccaatgagctgatcaagcgggtagccagtgagttggagaaaaatcgcaagaaactaatcaagcaggagcaggaattggcggatacggagacggcggagttggtgcggcaaaagggcgagctcctgaccacctatctgcatcaagtgccaaatgaccagtcgagtgtgcggttagacaactactatacgggcaaggaactggagattgagttggatgtggctttgactcctagccaaaatgcccagcggtacttcaagaagtaccagaaactcaaggaggcggtcaagcacctgaccaacttgattgaggagaccaagtcgaccattgtctatctggagtccgttgacaccatgctgggacaggctagtctggcagaaatcgatgaaatccgtgaggaattgattgaaacaggctacctcaaacgccgtcatcgtgagaaaatccataagcgtcagaaacctgaacgttacttggcaacagacgggaaaaccatcattctggtaggaaaaaataacctgcaaaatgatgagttgaccttcaaaatggccaaaaaaggcgaactctggttccatgccaaagacattcctggtagtcatgtggtcatcacagataacttggacccaagtgacgaggtcaagacagacgcagctgaattagctgcctacttctccaaggccagacattccaatctggtccaagtcgacatgattgaagccaaaaaactccataagccaacaggtggcaaaccaggctttgtgacctaccgaggtcagaagaccctccgtgtcaccccaactgaagataaaataaaatccatgaaaatctagttcatggatttttctgtattgaagcctactccgccttatcaatatcttctctaacttccttagcattgaacttagcaaaaagatattggcggtcttggactgggaagcgttggtctagttgatctactggccccacttccaccattccttctgagataacataatccatgacatgcccgccaaatgtcaaatcatccgaaataaaatgcaaatgatagccagccacactgaccccgtgaaaaatttctggtgtccaaataccaacaatggtacctgaaatattctcagcggtatactcaggctgacgacttgccacctccgcaaaacgaacatcagaagccgattttggaatcatgcggacatgcatccgtgaaaacgtccctttgattttgatggagcgaaaaagattttccccatcataataggattcaatccgctgatgcaattcatcgctggtcatttcaaagcgttgcttaaaaatcacttctgcttcatggaaaatgaccgctgcataaggaaccttcatctcagcaggaacttcaaccacttctggtttctcccctgctcccttggcctgataagcctttccatccaagacaatcagctcgccatcaatggaatccagggttcccaagcccaaatcaccatgttccaacaattcgccaaccgtcaaggagccgccatacagtccagccattaaggcacctaaggtattgtattgaaataatcgatttacttgcataacctactcttcattcaaaaattcttgcatggctaaatcgtctggcaccaattggatataacgactagcttgctcttttgcctcatccaaacgaccaagttgacgtaaaaccgctacgtaatcagccaaaaattcaggattctcagcaaattctccagccaattcatcgtaaagctcaatagcttcatcgtctctttctagagcttgataagccttggccacattccagcgagctagaacgttatctacctcttcatcaaataaagccacaacctcttcaaatcgttcctgctcaagatacagattggacaagcgcagagctagttcgttactatcatctgctacctcttttgcccgtagaagataatcttctgcccccgcctcatcatgcaattcataggcatactgagaagcctggagcaagagattggcgtcaaaatcatttttagccaggcctttttgagtcataaccaaggcatcatcaatcttatgctcgacatgaagcgactgagcataggcatattcatagccctcaaaatcaggattgatggtatccaactgcttgaaatagagatttgctttttggtattcttctcgttcaaatagcagagctgctaactcaaaaaccgtctgatcatcgtattccaactcaacagctttttccaaaaattcaatcgccgcttcaaatttccccaaacttgcataggcaataccaattcgctgataggtagaaactcccgttaattcgtagatctcacgattatccagctgggcatagtaggaaatagcctcattaaaaagctccagttccatatccaattctgctaagccaaagaggatgatgggttcatctgataagtgacttgcttctaacaatttttcacgcgccacatccgacaagccttctgcctgatacaggtccgccttaaccaacaaggcttccacatagacagaactgtcttccgaaatttcctccaagtatccaaaagattcttcaaccaagccatcttcaaatgctatttgggcaagattgatcagtacttcgggaaattcttctttgacctgctcatagatttgtctagcctgtgggaaaaaaccaatgccttctaagtaggctgccaaggacaaaagcgtttcgctatcatcttgcaccaaggcgcgcttgaaatacttatctgccttgtctaaatcctgttggtccaaacaaaccaacattttttcactattgttcattcacaacctcattttcttcatcttcatacaaaccactgtgtgccttgtaccattcaaatgccgctttcactaaaaccttaatagaggcatatattggaattcccagaagaactcctaggacaccatacatctgaccagctgtcaataatacaaacaaaatggtaatcggatgaatacttagggagcttccgataatcaatggtgtcacaaaacgaccttctatagtttgctcaatcataaagactactaaaacctttatcagcatgattggaccagcaatcaatcctaaaataacagctggaatcatggccaagaaagaacccaaatacggaattagattgaggaaaccagccatcacccccaaagttattggatagctaagaccaatgattgagaacatcactgaaaacatcagggcaacaataatcgcaacggtcacctgaccacgaacatagtttgataattgcccattcacatctgatagtactgttccaatcggttctctccacttggttggtagatattgggtgatgtgtttattcaaatactgaccatcccgtaatagataaaagagaataaagggcataatcaaaatagcaacaataatctgtgaagcggttgaaatcaaattacttgcccagttcacagcgcttgaagaaaacttctgagcataggcaacgatctgatcattgaccttatttaacatctccagagctgttggtctaaattgttcaaagcgctgatcctgtaggagcccagttacctgtccttcgattttctggatattcgaaggaagattttgcgcaaaagatgtcacttgctcttgaatactcggaattgccaccgccagtccccagataatgagaagactgattaaaacaaagagaatggaaataccaactgtacgagaaattttatgcttttccatccagtcaaccatcggatttaataggtaatacaaaagacctgttaaaatcatcggtaacaatacaatttctaaaaagcttcctattggtctgaataaaaaactaattttactaaaaataaatatggtcaaaaaagtcagcaaggttaccaataaaaatgtcaccgcttggctatttaaaaacaagcggaaaaaccaagtcagactaaatttttgatgcttatcctccatctgatacactcctagtctttttttctattgtaacatggagaaaggatttttgtaaaaatcaactacagaatctatacgactttctcagaaaaacatggtataattttatcaatcatttccaaaaaggagaatcctatggctatctatttcggtacctatacaaaacgtgaatcaaaaggaatttataaagcaaattttgactctgaaacaggacaacttagcaatctagaattggtcactgaagaacctaaccctacctaccttgcctttgataaggccggacatctatactccgtcggcgctgaaaatggtctaggaggtatcgctgcctttaatactgactatactctactcaaccatgttgtatcagagggcgcaccactttgctatgtcgctgtagatgaagcaagagatttagtttatggttccaatttccacaaagggcaactacttgtttataaacgtttggcggatggttcgctagaattagctgatgtcgctcaacacgaaggatctgggccgcacgaaaaccaagcttccgcccacgttcacttttctgatttgacgcccgataaatttttagtaacctgtgatttaggatgtgatcaagtggtaacctataaggtatctgaccaaggaaaagtagagaaaatagcaacctatcaggctgcgccaggaagtggtccacgtcacattgtcttccatactgtcgcaaaaatcgcctatctcatctgtgaactcaattcaactattgaggtgcttatctacgacggctggggacaatttgaacacctacaaactgtctctactctcccagaagaccatactggtttcaacggtactgccgctattcgcatcacaaaggatggtaaatttatttatggatccaaccgcggaaacgactctatcgcagtctacaaaacgcttgctgatgccagcttagaattagttgaaatcgtcccaacaaatggaaaaactcctcgcgatttcacgcttagtcctgatgaaaagcatttgattgttgtccatcaagattctgacaatgcaactgtattcaaaagagatgccgaaaatggctgtttgactgagctttcacacgatttctatgttcctgaagcagtttgcgttacatttttataagtcgtttcagttgtgaaatccgtacagttttggtttaatagtctcataggaggtgatttcaacatgaatccagtagatctttttaaccaagtaaaagaattgattgcaaacaaagactttgatggtgcaaaacaatttatcgaagaaaacaaggaccaattcggtgaatacttggaacaagcaaaaggcttgttatcaggttctgaaggtgttaacggtcttttagataaagttaaaggcttgttctaatacatgtaaaaactaggctgagaatgttcagtctagttttttgtttgttcaaaaatatttgttatctcttgcaatgaaggaattatccaatcgctcttcaatttttcattttcactggcatgcttcccaaaacctgtcagtatccgtacagtccacattcccaaagatttagcaggcagaatatcattatcaaacctatccccgacatagacaactctatctgcagggatgtttgttttttgcaaggcaagtgtgaaaatagctgtatttggtttagatagcccaacctcttcagagaggatgatgagttgaaaataagactcaattccccactctttaagcagttctctaatactactagactgattggcaataatccccaatcgatagttttgtgataacttctctagagcatctattgtttcaggatacaagctcacaccctcatttgtccacaaaggacgtggctcggtcggtgcaaaatagtgccaggtcgaacgaatgggatccagcgacttatgagcatactccaccattttctttttataagaatctgatgaaacctctatatccagagactctaacttcttcacacacttgtctatataataaccataagcagcctcttcatctaaaagcgtcgaacccaaatcaaaaaatatccactctatcatcccactctccatctcttttcaaaatgagaatacttaagttgatctgcctttttagaatatcattttatcaatatcaaggcaaagaaaattccctaggaatttcagtctagttttctattcattcttaaaaatagttaggacctatcttgtcatagattttcacgcatcaatagacatctttacgatgtccaaactcaagtgctaaaataaccaacttatcatcttgaatatcgcaaatcagtcggtaatctccgatacgataacgccactcgttagcatgattgcctgtcaaacctttaccattggcgcgtggattatcagtcccttctaagtgtttatcaatccaagcaaacaacagcctctgaatttgcctatctaatttcataatttgcttttgagcctttttagaatactctaaatgatacatgctataatcctagctctttcttaaaatcagcatgactaattgtttctggatctgctttgtactcatcataagcttgatgatagatttttaaatcatactcatcttcaatatcacgctccaaagctttcttaaaaaggctagaaagactttgacctgttaattgtgcatagcttttaaagaatacttcttcttcttgatttaatctgattgtcactgtactcatgatattcacctcgcttctttgtgttacattgtaacacatttttaaagtatctgtcaatctatcaaaaaagtaccttgggatgatgccccaaagtgccttatatcaaggctttacagcccttaaatcatataaagtcaaagaacaagtccgaatattttcagacttgttcttactatatccctcactatactagctcggggataaattagtacactgtactacgaaaaacaagtctggaaatttccagacttgttcttactataaccctcgctatgctagctcagggataaaacagtctcccagactgttttattttttcaagttgtagaatgagttcaagcctttgtagactgcaacttcaccaagttgatcttcgatacgaagcaattggttgtatttagcgatacggtctgtacgtgacaatgaaccagtcttgatttggccagcgttagttgcaactgcgatgtcagcgattgttgaatcttcagtttcacctgaacggtgtgatacaacggcagtgtagccagcttctttagccatttcgatagcttcaaatgtttcagtaagagtaccgatttggttaactttgataaggattgagttagcagcaccttctttgataccacgtgcaaggtagtcagtgtttgttacgaagaagtcgtcaccaaccaattgaacgcgtttgccaagacgctcagtaagagctttccagccatcccagtcgttttcatccataccatcttcgatagtgatgattgggtatttgttaaccaattcttcaaggtagtcgatttgttctgcagatgtacgaacagcagcgccttcaccttcgaatttagtgtagtcgtaaactttacgttctttgtcgtagaattcagatgacgcacagtcgaaaccaatcatgatgccgttttcaccagcttcgtaaccagcagcttcgatagcttcgatgattgtttcaacaccgtcttcagttccttcgaacttaggagcgaaaccaccttcgtcaccaacagctgttaccaaaccacgagctttcaagattttcttcaaagcgtggaatacttcagcaccccaacgaagaccttctttgaatgaaggagcgccaactggcaagatcatgaattcttggaaagcgattggagcgtctgagtgagaaccaccgttgatgatgttcatcattggagttggcaatactttagtgttgaatccaccaaggtaagtgtaaagtggcacttcaaggtagtcagcagcagcacgcgcaacagcgatagaaacaccgaggattgcgtttgcacccaatttacctttgttaggagtaccgtcaagagcgatcatagcgcggtcgatagcttgttgatcacgaacgtcaaaaccgatgatagcgtcagcaatcacgttgttcacgttgtcaacagctttttgagtaccaagaccaaggtaacgagatttgtcaccgtcgcgaagctcaactgcttcgtgctcaccagtagaagctcctgaaggaaccataccacgtccgaaagcacctgattcagtataaacttcaacttcaagtgtagggttaccgcgtgagtcaaggacttcgcgagcgtaaacatcagtaataattgacattatattactctcctttgagtttaaaattgttacatagctatcataccctaaaagaagggatttttcaagaaaaaacaggttattttactgaaagaaataatgtaaacgccttccttttcaaagttaactgagtatgttatactgaaaccatgaacgatttaaatactaccatactacagaaagcctctggcgaaacacgattgaatccagatgaacagcgtctatacatgggaacctatcgcgaacgggttgtcctgatcgtttcctttgacgatttgagtagtgaagtcgtcggaaataagttcgatacaatttgccaaaaactagcaaacagatactctcctctattcctcaaactctcgccagccctgtctgacaagcaacaaatttcactactaaaaattgctcagacctttggcattactaccgctatcatcgatgaaaaaataggacaatctccctacgcacttgtctttcacacaaatcacgctgtggataatgaagaagttagcttagaatccatatttccaaatcttatctcaaaaccagaagaaaaaaaggaagatgcaaaaccttccttctggaaaaaattatttggttagacttatttaacgataaagcagtataaatattaaagtaaaaataatacaggttagacaaaggattcctagcaatctgcctctttcattttttcattgaaaaagaacattgctccgtttgcctttattacattcatttccgttactctttctttttcggaaagtctcataacggatactagctttgcaagacaaataaaaataaataagataatagccacatatttcactaattccatctttgttggcctcctaactgaagaattcttgccacctgctctgccgtgcggaccaggtttttttctgctttttgaagcgtgtcctccaaactttcaacgcttgcaattatcggaaaagcggcgcagatattttcaaaaggaaactcgggaagatcgtctttgaggctaccacaaattgcaatgatgggaatccccgtcggcgtccgtctagctactcctattggagtcttccctgataagctttgggcatccatccgcccttctccgaccacaaccagacccgctttggtgacgcgatgatcaaagtccaactgatccaagacaaagtcgatgccttttcgaatgcgagcaccagcaaattggactaaacctgctgccatacctcctccagcacccgctcctgccaaatcgagtagcattggattaactaatttataaaaggactccattttcttgtctactagttcaaattcagcagaggtaagacctttctgacctgcaaaaacaaatgtggcacccgctggtccgcaaagcggattctccacatccgttaccaaatcaatcctgacctgagatagatctaccaacatatcctctgtggaaaagctgacaatctccccgatatgagctccaattgcctctacttcttttccctctcgattataaaatttcactcctaaacctgccgccattccgataccaccatcatgactggcagagccacctactcctataaatatgcgtttaacaccattttgaacgagctccacaatcagctccccaaccccttgtgtcttaataaagagaggactccttctttcatgcgggatacttgccagccctacaatctcagccatttcaaaaaccgcaagatcatctttaaccgcataggaaaccttaattttatctccaaatggacctgtcacccaagtctgggttccatccaaggataaggcttgcattagactctcaactgtcccttcgccaccatctcctaggggaattaagtcataccctgcttgtgggtaaactttagaaaatccttttttaatcgcttcagcaacctttgtagctgaaagagactctttaaatgaatccggagcaatgagaatatgcatggtactaacctcctttatattattagtatatcacgctcctagtcagctttcaataaatcttttctgtttttcatcgtctgtgttatactgaaagaaaggagataagtatgtatcaaactatattatttgacttagatggaacacttactgattctggacaaggaatcttaaactccgtcgcctacgcactagaaaaaatgggaatcgaagaaccagatacagccaatttaaaccgattcatcggtccgccactctatgaatctttttctcgattctaccaactcagccctgaagatacacaaagtgcagttgatgctttccgtgtctattttaaagaaaaaggaatgtttgaaaatcaactctatcctggaatcatccctctgcttgaagaattgagaacggctggaaaaacactagtaattgctacctcaaagccagaaatatttgccaaacagattctagaacattttggtatctcacactactttgatgtcattgccggtgctagtctggatagtagtcgcatcagtaaggcggacgtcatctgctatgctataaatcaattagaagcatttccaaaccatgctgtgatgattggagatagggaacatgacattgaaggagcacgcatgcaccaacttcccgccatcggtgttctttacggctatgggaacaaacaggaatttgaaaaggctggggccaccatgatagtcgaaaccgtccaagatttgaaaagggttttactgacaacagaatagaagatgctgggcaaaaagaccaacctcgcttctcagggttcgtgtcaacatctcagcgcagtggttgattggcagatttgttcgtgttttacactccaaatctgacctctatgactgatgcgaacagagttcgcttcatttccaacctcaaactgtctcccagacagtttgagctgtgcgggggtgggagtgaaacagtctggggatagactgtttcagctcaacaactagaaataaagacttgttgacgaactctttttctaccatttgtcaagtctatcaaggctttaagcaaaaaaataaagcataacagtagctattttgaggctgctaccttatttttgtcactaatttagctataaaagggcatgacaaaatgacaccttatctagtattttttgaaataaggtgttacaatgatagagcataaacagttttaccgattttgggttgaagcgtaatcgtaaagtttgttatgcataatgaggtaatacattgtccgaatgagacgatgtatggaggcaatcgtgtgcggcttcgttgaagtcgtttgcgattgtctttttcgtttctcataaaagtctgcgatatggcaaggattggtatgactgactgaagcgatattgtggatacacttgaacagaatctttctagcgtagggattgccacgcttggtaatgtgttccttagcgaggaagttaccagattcatagtgtctcaggtcaataccgataaaggcattgatttgattggcagactgaaaacggcgaatatctcccagttcaccaataatacttgttgcagtcgtctcagctattccaggaatagagagcagaatgtcatattcaggtaatggctgagctagttccaccatttggtctaagactgcttgtctctgttcagaaagccgaagcaattcttttgcatagtaatgcacctcttccagtattggagaggttttcttgacggcacaatacgattgattagctagtgctgtcagcttctcagctaagtacgccacacgcttgtcagaaatccgttttgaggtggactgacgaatgctctttgatagttcattcttgcttaaatcaagcacgaagtccttgcaaggaaaggttatgaccaagttccagtattgttcgccagttggtgttgacaagatattttccaattcagggaaagtgacttgtaagaccttgtgcagacggtttttagcccgaacaatgtcctcggtcagattctgatagaaacggctgagatcccgcaagttttggtagacttcttcttggacataagtgggtttacgattcagcacaaattgagattgagccagtttttcagcgtcaatttgatttgttttccgcacacgcaagctatccagttgcttcttggcttctaagggattgagtcgtgtataagcgtagccatgttcatccagaaaagcttgaagacgacgagaatagacgcctgttgcttcaaagatgatttctggcttgtggacggttttcaaatcgccaagtagccgagaaaagccaatggcatcattggacatggtgtagttatgtaccttctcgccgttgactagaatggccacttctgaacttgccttactcacatcaatcccaaaaactactcgcatgatattacctctttgtcttgaatgattccttgttttagtgatgtcattttcaatactcgacgtctggcgtcccacatactttgataacattctttctaaaacaggtgtcttgccagtttttgttgcgacgtctagcgtcaaaagagttctcgacttaacaagacacctctactttatcataaagaaaaagtagtgagtactttctcccgtcggagatttcctcactactaatcttagtatgtttttgattagtcgagttctttcccgctcccattatttactatctaaaatctctattagtttatagagatttttttcatttatttggtagggcacctgttcttggacaatcggtttagcacagaaagctactccaattcctgctcgttgaatcattggtagatcatttgctccatcccccatggcaatcgtttgagatagactcagcccattttctgccgcccattcttctaaacatgcttttttagtatctttcgttacaatttcacccaacacttgtcccgtcaatactccatctactacttctaatcgattagcccgaacatagtctaactctaactgtgcagctagtcgatcaactgtttcatgaaacccgcctgaaacgactgctaccttatagcctcgcatttttaattctgagactaattctgctgctccaggcgtaaagtggatttttttgataattcgatcaaacacagaaacaggcaatccctttaacaacgccacacgttcacgtaaggcttcttcaaaatccaattccccacgcatagcacgttcggtaattgctgcaacttgcgctcctaaaccggcctcttctccaagtaaatctattccttcttccaaaattaatgttgaatcaacatccataactaataatccagttgtcatctccaatattcctttcaatgtataaaaataaaaagccaaatggctttttatctagtagcgaatggcttcgcgagttttttcgtatgaacgcacaaaacgctctgttacaccaggttcaactgtttccagagcaaatgaaatttcttcaaatgctgcttggtaatcaaaatccttttcaaaaattgataatgaacggttaaatgctttttgcacactttcatcgaatgaacgataacggttagagtattgtagcaactgctctgtcaaagtcgcattttgcacaatcaaatacgccaactcttccaattgattcatatcatacgttgcattttccaacaaacggttaacaacttcgatattgattcgtttatagtctaactcggcaatcaaggcttccacatgatcgctcgttctaaagaagtttgttaaaaattcagctggaattcctggaaggttgcgtttttccatataacgcttaagggtatgcaatttgttgatataaagtgtagctttcttacgcgctgtgttctctgacaattcttgtgatttaagatagtcagctaaaacaagctgctcctcttcgatttctttcaagcttgccaatgaatgatccaaacgctcttctaaaatagaatatgcaacttgtggattttcaatgtcttccacactttctgtaacaacaatctcaatcgattccaaacgagctttaagctgattgatacgtgaaagtttgctatctgccagcaagtaagttgcatttaggcgttggctttcctcatccaagagctgtgtattttggacaacatgctccaagaattttggcaagtttttactaatcttaacagcttccttattcgcttcgatttcacgattgaagactttatacaaatgatcaatttttgcttgaattccctcattttcagcttctgcggcatccaaatcaaaggaaacaatcaaagcagtattttcacgaattgaaacgcgaatattttggaactgtgactcgatgttagcttctgtgaacaaataattctgctcaaccagtttacgataacccgactccaaatcttccaattgctctgggaaatcttttgtaactcgttcaatcaaacttggaatgcgatccatgatttgattgagggcaatcatatgctcttcagtcttatcaaggatttcagaagcttcaatcgggtcacctgaggaattaagcatcacaaattcagaaaactcaacttcaatatttttcaattgtttctcaagttctgatagtgtctcaccgtagctatctggattttcacgaacagcttcctgtaaactatcgaacaagtttaacgcatgttttacgcgaccagagtttttctcttcttgctccttcaactccatcaaaccttgacggatagaggcaatatcttcttcaattaaatcaatttggctgtcgatactgtcgatagcgttctttgcactcacaaagcgaaaggcattgttatagccttctgcctcaaagatatgattttcaatatcggcaaatgaattgagcgacaaatcaacccatttttgattccattcacggaatgacacctgactttgaccaatcaaatgaagtgctttgacagtttcgacttcttcattaactggaaggttaaatagctcttccttacgttcttccaatgcaaccaaaaggttgtcatttcgtttacgaacaatcaggcaagctacataggcaatgattaaaataataacaatcgaaacgattaagatgattgttcctgtaggcatgtaaatctccttagctcatagtaattactagaaaatatcgcttaattataccataaatctctagtatatgcacttgtttttttagtttttagacatccaatgttgaataaacagcattttcctcgataaactctcgacgaggttcaaccttatcccccattaacatgtcaaaaatcttatcggcttctgccgcatcatcaactgaaacgcgtgccatgagacgattttcaggattcatcgtagtttcccacaactgatgatcatccatttctcccaaacctttgtaacgttgaatcgttggcttggaccgtcccgtactatgtctttctaaggcatcttgcaattcttgctcttgattaaccccaggttgaatatattcttttatctcacttccaaccttgataccgtaaataggtggttgagcgatatatacgtatcccgcttctacaacaggacgcatgtagcggtaaaataatgtcagaaggagtgtccgaatatgggcaccatcgacatcggcatctgtcataatgactaatttttgataacgtgccttgctaacgtcgaaatcagcaccaaagccagttcccatagctgtaaatagactacggatttcttcgttggccaaaatcttgtccatgctggctttttctacgttcaaaatcttaccacgaatcggtaaaatagcctgaaattcgcggtcgcgaccggatttagctgaaccaccggctgagtccccctcaacgatgaaaagctctgtcttcgctgcatcatttgaggaacaatccgctaacttacctgggaggtttgaaatctcaagacccgatttcttacgagttacctcacgcgcacgcttagcagcaatacgagccttgcttgccaaaatacctttttcaacaatccgtctagcaatctgtggattttccaaaagaaattctgcaaaggcatcagagaaaaggcggttggtaattttgaccacttcactattcccaagttttgtcttagtttgtccctcaaattgaggacctgggtgcttaacagaaatgaccgctgtcaaaccttcacgcacatcttcaccagtcaaattatcctcattttctttgagaattttatttttcttggcgtagtcgttgataacacgtgtcagagctgtacggaatccttgctcatgggtaccaccttcatgtgtgtgaatattgttggcaaaactaactacgttttcatgataactcgtcgtatattgcatggcaacctcaacggtaatatcatccatttcaccttctgtatagataggggtctcaaaaatgacatccttgttctcattaagatactcaacgtaggaagcaataccaccttcatagtgatattcctttgtttgctctactccctcacgtttgtccgtaatagagagatttaaaccacgatttaggaaggccaattcttggatccgcttatttaattttgcaaagtcgaactcagtcgtctcagtaaaaatttctggatcaggtgtaaaatgtacagttgtaccagaacggtctgtttctccaacaacctccaaatctgcaacgacttcacctcgtttatactcttggaaatatacctgaccatttttgtagacatggacgtctagctgagtagatagggcgtttacgactgatgaacctacgccgtgcaatccacctgagaccttataaccgcctccgccaaatttaccacctgcatggagcactgtaaagacagtttctaccgctggacgaccagttttttcctgaatatctaccggaatcccacgtccattatcaataaccgtgatggagttatctggctcaatataaacttcaattttatccgcaaaaccagccagcgcctcatcgattgagttgtcgacaatttcccaaaccaagtgatggagaccttctttagatgttgagccgatatacatccctggacgcattcgaacagcttcaagaccttccaagacttgaatctgactggcatcatattcttgagccttctcttgtaaatctttgatttcttctgtcatttcttttccttattttctatttgttgctccttaaaaatagaaaagccaatccatctggataaaagcgaaacatatttttagagcaaaaatcattctaacgaataccctttattataccatattttctaatattttgatagaaaaaagaagaggaaacattagctccatcttcttcattactttaactatgataaaccattgtttgagctaggctttccccatctccaccaaataaatcaaccaatttataggcgaaatccaaacttgttccagcacctcggctagtgataattggaccatcaacgaccacatcctcttccagatgaatacctgacggaatgtctttttctttccctgggaaacatgtatagtgacgactatctaacaaaccagccttatccagaacaattggtgccgcacaaattgctgctactgattttcctgatgcaaccgctctttgcaattccgtaatcagtgactctgaatctctaaggtgaacagaacctggcattcctcctggtaaaacaatcagatcaaaggaagacaggtccccatcaaagacttggtcagtttgaacacgaataccgtgcgatccctccacttcatgactatctaaaccaacaatctgacagtcaaaatgagctcgacggaatacatctacagaggccaatgcttcgatttcttcaaaaccatcggctaaaacaaccgcaactcttgtcatataaaccaactttctaacgttttatcgtaatttttctatagcgacgtgatcgatttgtttccttctcatcagctagtcgtgactgataccccattgacagcactagaccaacaccaatcagatttgaaaccatggacgagccaccttgggagataaacggcaaaggaatacctgttaaaggtaacaaaccagttgcagcgccaacattttcaaacacatggaacaagagcatcatgatatagccagttgatatgtaggtgtagtatcgattgtttgacttcaacgttacccgcagcattcgataaatgagcaacaagtatagtccaatcaataccgtcccaccaataaaaccaaagtcctctccaatcaccgtaaaaatcatatcactttctcgaacaggtataagaagatttgttttattgaaacctagtccttttaagccaccacttccgatagctatcaaactttgagcttgctggtaggtcgttgattgggcatttttaaagggatcaagccaggctgcaatacgattgattttataagtatccatccccaaattgtggagaaatgttgttccaccaggagaaataaaaatcagcataaatccgccaaccaaaacgatacctgttaaggcagtcggtaatagaattttccaagaaactcctgataatagaagcattccgctaaagattgctacaaatactaaggaagttcctaaatctttctgtaaggccaacaaaatcaggacagggatagtaaacagtgtcatataaccaatcaacataaaatcctcacgaatttttcgatttggataatatttatgaaaggtgacaatcacccttgacaacataatgatgtaggctattttcataaattcggatggttgaaaaagagtcattccaccaatcgttacccagttttttgctcccgttgatgctactaagtctggactgtagaaaaacaaaggcaataccataagtcctagcccaagtacgtacaagtaaggtgtgatttgccacagaaacttagtggaaaagaacatgaccaaaaaagctgccactgttccaattcctatccaagcaatttgttgaccaaccatctgtacaacattatccggataatcttgactaaccgcaatgtagagagaaataatccccacaactaataaaaaaaagaccggtaaaataagtgagtagtctactcgactatcgattgttcccctatttttcatcaatttcctcatactttcacttcaaattcttactcgttccattatagcagaaatcatctctcattgaaactaaaaatctagttacatcagtggggatacgatttatactcaacgaaaatcaaaagtagcctaggaaacgaagtcgaagatagaactggagttcatccaggcaagttgacaacggataattttgattttcgaagagtattactagtgcacaaatcataaaatacgtatatcttcataccttcgaacaggctgaaatataatgctttaccttcacacaccccataagtttgctcaattcatgagtatgtagaccaatggcaatcattttggcaatcacgcacgaaaaagccctctcttatttctagagtcaaagaaaaaatggtccactggaccataactcgctcttttattttcaagctcgtgaaaaaacagtccgttaaggactgtttttttatttgagaccgtattttatacccttttatttattatcatttttcattaaataataagataactatataaatagaagaaagattttattaaattcttatatattcttatcaattatcatcaatcggaactttttccgttactaaaacaaagattttccccacctattccaaggaataaagattaagttattttatacacttttatgaaataatatacaaaaagttggtattgccagctttttttaatgtctatttcaaattttacactattggtatttttattattttttatgtatcaattttggtcaattttgggggagagatacacaagaggattgacaccgttattttctgcatgtgctaacattctaaaccaggggggataaagaaaaagtctcttgtcataaattctacaaaatttttaccccctttttgtctaacggttcccgacttggaagaagttcccttactcggttcccaatcatttgaacatatttcaacagggtaggggggtaaaatataaaatcaacaaactattataatctaattcgtttttgacttacgataaatgtatgctagatatattttccgatgtccctttcccgttgcacgtttccccagcagaaaagcggtttgtttaggcatgggggcttatttatactagactactatcatcagtgtaatagttgtttataatatttttcacgcgagaaaaaatgtacaatgacggcgtgaagtccaaaggcgatagggtggtagggtacacccccctatcttccaaatgcactacagacaatagataagcccttaatactaacatgtaaagggcttaatggttttatattcttttttgtatttttggagtggttttcgtgttcgttgaattagtcatatcttatattctgtctaattatgtttcactctctaaactcaatactatcaaggcttttagctattccttaaataattactagcattttcttcattatgtctaattaacactcgatatttcctttaaatgtcaaaattagccatcttagtatctaggtcatcttgtctaactcctatgtatattagcgtgattgctgggcttgaatgattaaatatagacatcaaatcagctacattcttatactttttataataatgatagccaaatgttttccgcatggtatgagtaccaatattttctatacctaaatcattcccagcggtctttaatatccagtaaactgtacggcggtcaagcggtttgtttacaccgttacggctttgaaaaagataatgatggagcggtttgccttctacatacttccttaactcattctttagggttcgggtcattttaatagttttctgtttaccagttttttgttcccgtactctgatgtgccagccttggacgtccttaactcttaattttaaaatatcgccaattctaaaccctgtgtttattcccacaagaaatagtatatagttcctttcattccatgaccttagatagtccttcatggcttgaatatcgtccttgtcgcgtattggctcaactgcattcattcgcttcttccctttcttcctcacgcgcattcagattgtcatattcactagcggacttattcgggaaatagtgacgctctaagttttctaaccattgggcgtgcccttccatcattcccttatactttccatcggttcgcgttctgaagttctctacattggtttgcttcaataattccaccttctttctgtattaaaattacaacaccttacaacgcttaacaacacttagaattataaagtgttgtagcggaaacccttggggcgcaaggggtttggagatgttactacacttactacactttttttgaatacgttgaattttttataatatatatacatacacaagaaagtatatttcttttttattactttatatattataagtgtagtaagtgtagtaatattccgtaaagcgttggggctgttggggtttcgtcactacactttttctaaaaagtgttgtaacttattttttcttatagcccctctgcgccttccctttaattggcacatataggggtaaatagtggggctggtcatccttggggtagaaacctttgggaaggtctgcccctcttggtaaactaataggataagccaatttttcccagttatcgggtaaatattgcggaaagtgagtatgaaaaccttgactactgaaattatgttgaaaattatgataatctgcaaaacctgtaaagtaccaccatacccaatcattaggaataaaggtagaatgtaaattagtaaatagattttgtgaaaatgctaaaacagggtctatagtttcctggtattcgtctagtaaatctattgacttgctaggctctataaagtccttgaaatctaggtcgataactgtttttaacacgtattctaggacgctagggcgcgtgatataatcgtttttaattgctcggttaggtttccccttaaagtgcttattaaagggtaaaataaccattctacgccgtatagcgtgatagtctccccgtatctttggtagggtgtttgttgattgaatgacaacggtttttataaaagtactatacgcgtcttttccttttttctctaccgttacagtatccccaccaactaggctgaatagtttagaagtatcacgaataaccgcaccagcttgcacatcgtcgcctattatggcttgttttccgattgcttgggctaaggtaaaacgattattaacatctaagtctgttatctttatacttgctatgttctgccgtcctattaggtttataaataactcttgtagcgttccctttcctgttccaccttctcctacaaaccaaaacattttagcgtaactttctccacgtacaacggcattgagtagctgaagtgataactgataaagttctttatccccgttaaataaatctaatagccagccattaaactcccagccctttatagtcgggctttgggcgtgtggattgtagttggtttgtatcttatgagtgaatacccttgtatctgtaaatggttctagtgtccgtgtctttcggttgtagataccattgccaactattatcaaatgtggggcgttttccgcctgtctatgtggtgcttttcgggttaagtggtaaatacaatcgctagcccttttttcgttgtgccgtggctctataatacttataaagtcttttaaaaattccctatcattgatataaattccctcatcagggttataaaaataaacgggttttgttccctcatcgctttcaattctgcaaactgtcagcaattccgccatatattgggcaactatcaaaggtggaacaggctttttaatttctgcttgtgcctgcttatcgtctaacccgtcttctaatagctttctatagcgttcttcctgcttgtgttggacaaattgaaatactttcccttgccaacctttaaacgttctaagccgtatatcacgcgcattatattgcgtttctcctgttatttgtcttccatactgtgtaatactgcccaccttctttctatggtctagcttatgatttttgtatcttgtttttgctgattgataatgtatgctattgtatttcctgtagcttcagcaaaataaaaccgtttcatcacatctaagaaataacttgctaggcttgaccgtttcacaatagcagtaaataagcttactacttgttcaaaatcatagccatgtaaatacatttgtctaataaaaatagccgtttcttcctgggtgtaaattccatttgcgatagtatcaaacacccagccatctaaatataacccgctggcttgtctttgctggtctaacatgtatttctcaatgtcttctagctttgctaatagacttgttttcatgatacttattggataatctctaataagttcccaccctttcggggctggtactttttcaaatactttcaaagtaatattgtttaggctgaaaggtgtgatatatccaccaaatggcaagtagtagaaaaagcggaaaaaattatcttgcattactgcgcgtgtcggattatcttttagtaaatctagtagtatttgttccccacgttttatagtcacttccacaatgctatacatctatttccctttctatgttctttcgtttctctatttgttgtttaacccattcagccctatctttatcatctgacaaagatataaaaatatctatttcctcgcgtgatatttctcccttaagaaaagctattatcacttgataaatttcggggttttcttttctaacggtttctaatatttcttctatatccattcttgaaactcctagttatatctcttgccagcaagccaaatataagccccgtagttatcgtttatatgttgcgtggtatgtttaccctcagaaacttttttaggcttgctaggggcttgaatactgcctaaaccaacgccaaaccatagaaagaggtttagcggtgtaaatattgctatgagtgtgaatgcttgttctattgtcatttcttgcatgttacttacccccttaacttctatacctcggcttctagcaatacttcaagccgtttcttttcttcttcgatttgtttttcaagcgctcctatacctgccattagttcgctatgattggctggtataaaatagcctttatgattgcctttgcggttgccaataattggtattttatgcttgattatcagccgtctaacacattccctaaccgttcttttatctaggttggtttgttgtgctatgtggcgcgccgtgatggctttttcaatccctacaccgattaggctatatatatgcttgtcgtttccttttaagtccattttgacccctttccacattgtattcttgtatttctggtattagctcgcgcggtggcgcgtgctttttccgtgtgttgacctgtctacaatttttctttactatacgtttttttatctagactatccccagcggttgcccgccccaaacttatcttgtaagtgtgtgccaaaataatagcctagctaatgtgtgctttatgattttaaaaatcttaatatcttgaaataaataatattgacttgccttctcattgtccttatggtatgattaaggcaataacaaaggtgtgcaagggttcgcccttccctggttattgtttaatcatttgaaggcttgtcagtttggtcgctggtgtaagccttttttgttgtcattctttcaacttttctagtatttcttctacatctcgcacatcatagtagatagacttcccttgacggcgtgaccttaacccacatgactttaaatatttcatgtatttgtggtcaaagccgtataactccattacttccccttgtcgtaggggctttttgtttagccgttctatttcgtcctttgccatttcacgcgccaaaactaaggcaccgcggacaagttcaaggcttgcgctttcgcttaacaatgcttctgccatttattttttccttcctgttcaatatgccgcctaaaatcgtctatacggcgttttttttattttctggtatctttatactacccgttctaaaaaatcgctagaatgtactttttttgagaatttaaccccctctaggcgtaaacctcataaaattctttgtaaatgtcgtcggggatttccgttagggcttgttgttggagttggatagcctttaggcggtttgtatcgcttgccgttggcttattgataatgtccgccgttgctaaaacttgcttgaaatactcgtctagctttaacttccgcccctcggtaatttcttgtttttcttctcgtttggtttttaagaattgaaattcgtcaatttcatcattcagcaagctataagagataatgccacggtgtcgccattggttaaaacgtgccttaattccctctatcgtccaacctttcagccgttcttggagtaaatcaaagctaactagcccattatcttcataaacctgtaggagtagttcctgtgtaaatggtgttttagtcatttcaaccccctctaaaatccttcccacgtcattagaactatatcttctgtggtgtactgtgtattttttaacgtttcaagttcttccataaccgctttaaagtcttctttgctggttttgggttctaggatttctattgctcgctcgctttcttcattgattttagcccaagcaagtgttaaataggctacattattaggttcaagcgttttttctagttcctttgtaaagttttgtaggctttttgaaatatgtttcatatagaaagcgtaggtggtaaggtggataagttccgcactattaatggttacaatgttatttgtctccatgttgtttacctcgttttttcttgccttttgctcgataatgtagggtgtgttcttctagcatttcttgaatttgtacccatgcttgggcgttttgttccaccatatcgtgtaaaacttcagcattttcatctagccccatagcttccgccatgtttacctggtcatctacccattttttaaactctttataggtttgttttttgctcattttgtattttctccttctaatgttgtaagtaaactatcgattaaggtttcaaatgttccagcaatttcatttaattctttacctagactttttccttctgattctaaggtttcgccaatactataaagtttttctccgtcctcattttttactagttctaaaaatgtgccaactgtttgtttatgctcgttatcctctccataagtgaaaagtactgtatttttgtcaatcatagtcattgtgtcttctcctttaatttctcttgtaaatagccttgtatctcccatatgaaacggctaacggcttcaaatttgcccgctagggtcgtttctatggcttcattattcaaactagctagataatcggtaatatagtctagctcttcatctgacttgttagcacgctctaggagtgcttcaagttgtttacttgccattgtctgcccctgtgtcttttgtatgctcccaaagggctttataatcgccgtcatggtctaggctttctagtaggtaaagtgcttcgtcgccaaaatctgctatatggtctagtgttgtatttactgccatttctgggaagtctgtgtctagtgtactgtccgctatatccattagcattagttctaggcggataaccctttctaagagttctaggcgtgttgcccgttgtcctaaaaaggctctacgctcaatacagtagcgttcttcaagtgtggtcatgttgtatttcctttctagcacgcgcctgcgtgtttattctttggattaggtggggaaacctgtattattgtttaatcatttgtttttgtcgttggtcgtagttttaaggggtacgcccttaaaatggtttttagttctttttctgcgcgtgattgcccttggtcggtggccaatcatgagtaaatagccattgtaagatagctagaatgtgcctagctgtcttttttagggttagataaagtagtccgcctatggtttacctcctttctttgtctgtgtcgttttcctgtagtgtgtgtgaaaggtagttaggaaaattacacatcttctagtagccaatttatgacactttcatagatacggcgcggggcgtcatagttgccctgctctactttggtcaaggtttggggcttaatacctagcttttcagcagttgccttcttcgttagcattaagtccgcacgcttgcgccgtacttttctagcatggtcttccgttagtagcatttatacacctccttccacggtcttaaaagccgttttttgctacacttgagattttaacgcatttaaaaggcgttgtcaagaaaaatacggctttattattcatattttttgtttttatgttataatgtgccatgaaaggtagttaaaatatatgaataagctaaaaactttgagaaaagaaaataatttaacacaagaagagttagccaaaaaaattggggttaacttacgaactcttcaaaaatgggaaaatggagaaagctctatcagaacaaagaatgctgaaaaactagctaaacatttcggcgtaagtgtagggtatttgttggggtatgaggacaaagtaaaaaaagaattctataaacaacttgacttatacaatttagatgaatttagaaagtttagaataaaattaaatattgaattatctctgctaaacggtattttagataatgattatgaaaaaatatctgacaaagtttcttatctaaacaattttgctgataaagaattaaaaagaggtatggaaaatgaatgtttagaacctcaagaattacaagaattatttgagttacgaaatgttgcgagctattttacatctttggtagaaacattagaacaactccaatataatttaaaaaaactgttagaggatacgggaaaagacacataaaaaacgcaaaccccagcaggtcggcgcgtggaataaatcaaaaagaaaggaaaccatgcaacattacagtttagacgaatcaggaagcattactacaaacaatgcccctaataaccgtttttttatcattgctggagtgactgccacaaacaaagataaggtaaaacgggtattcagaaaagccaaagtaaattacctaaaacacaatcccgatgtactactagacatcaaatcagaaataaaaggctctcaaatgtcaatagagtttaaagactacgtttttagtcaacttatttcaaaaacagatatacaattcaattacctggtatttgacaattacaacgccttgccacggctaagagaaaaaccaaacattacttttaattatctgatgttcttaaaagctgataaactcctaaacaatcaaacaccactaaaactagacttggacgatagaaacaagagtgtcgaaagtttaaaagccctcgaagagtatctacaaacaaagttgtgtgtagaaagtgatagggtttcagatgtgaaagttgagttctttaactcagcaaaccatactatgatacaaatagcggatattttcgccaatcatttgtatagaatattcaagcaagtagcaaaaaatcaagattataccgaaaatatggagctacttgccaaactgaaacaaactaacctacaacattgccaatacttcccagctggaaagtgtgaatgtgcagaccttttttagtgataagtagaaaaaagcacgaaaaaacgcaaaaaatgacataaatagttgaatttttcaataaaaagagttatattaattatagaaaaggctacttgtaattctgtttgtgtctgcgtattgtcgtaagctgcctgtgtggtatgccagccaacagttaagggcttttttaattttgtcattacaaaaaggtggaatagtttttattctgccttttattgttattctacgatgttacggaaaaacgccaaccccagcaggtcggcgcgtggaaatatacaaattgattgacatataacctataatgggggtataatcatagtgtaaagaattgttgtgaggacaattctagcactaaatcaaaaaagcccccaacgtgccagcgttgagggtttttgtttgcccctgtttggggttagtcgtcgttatcgtctaaataatacttaactacttcagtcaagatattaaccaataacggcgctagaatacttgtgaggataagttctagcaactaaatcacctcccttcagtaaattcagggggcttgtatatcttatcagataatttattttgttgtcaaattctccccgcttacacatggcaacgtgtaagcaaccacttataaacacgcgcatactattttattctttcgattaggtggggaaaccaataggaaggataaacaaatgattaaccaataccaactaaaagacggctctattagatactcttatattgcttatgtaggtatagatccactaacaggcaaagaaaaacgcgtaagaaaaagaggttttaaaactaagaaagaagctaaaatagctgaaagccaattacttctaaaagtggagcaagatggattttttgacaagccagatagaataacctttgaggaagtctataagatatggctggaacactataaaaacaccgtgaaggctagtacatacgccagacaaaaggcgcaagcagacctacatatagtcccagtattcggcgcgtgctacgtggataaaataagcctaccaatgtgccaaaaacaggcacaagaatggtttaagggctacaagaaatatgctaactttatcggtatgactaagatggttttagattttgcggtaaatctgggttatattcatgataaccccatgaagaagataataaagccccgtaaatcctctgaagtcgatgaagaagaaaagaaaaaagaaaacttttacagccgtgaagacttgcaaaagttcctagactgcgtagcaaaggaagacaaggaagaaatagcttgtattttccgcttactcgcctttacaggtatgagaaaaagcgaagttcttgccctacggtggaaagacttagacctctttacctcacgtttatcagttagccaaatagtagcctacggagaaaataacagtatcgtctatcaaacacccaaaacaaaaaagagtaagcgcactatcacgcttgaccctattaccgtgtctattctgaaaaaatgggaaaagactagacaatttttaaacttcccccagcgcgtgaaaccaactgacctagtttttccagcagaaacaggcaacgcccatagttttgattatataaactataatctgcgttgtattctgaaaaaatatgacttgccttatataacgccccacggtttccgccatactcattgcagtttattatttgaagccggggcatcgattaaggaagtacaagaaagactagggcatgaagatattaaaacaactatgaatatttacgctcacgttacggaaaatacaaaagaaaaaacggctgaaaagtttgcccaatttttgggaatgtaacgcccagccgttaccatttccgttaccatttcaaaaagaaaaccattcccacggcacgggaatggcttaaaatcaacgtttctaacggttttataacgctgattatttgagaccgtattttttgttgaagcgatccacacgtccatctgcttgagtgaacttttgacgtccagtatagaatgggtgtgagtctgatgaaatttccacacggatcaatgggtaagtttcaccttcgaattcaactgtttcgttagatttcttagttgaaccgctaaggaacttgtagccagtagttgtgtccatgaagacaacagtgcgatattctggatggatatcttttttcattttaaaattcctttctgccatggactctttccgagccatagattataaccatttaagtttaccaaaactttgttcttatggcaagtctttttacctatttttttaatattttttcaagttatagtacagaagcacctgaagcaaggtcagaagttactctggcgccaaatccccctcttgaaggactgcccaagctatcagaaattctttcttcaccagcaagaactttctcagaaagccctgaggtcactagaatcctgccatccagcccaatcagaaccgcttcgataccatcagtttcttctaccatcttataaatccgagttatttcttgaccaaacagtcgagtcgtccaaatctcaccatcaacagattgtttggacacaatggtcaaactagccagctgcgactccattggatagccggtctcaggactcaaaatatgatgataggtctttccattcacggtaagggttctttcgtaaataccagaggtgacaaccgattcttctcctattttgaggacgagggcattttcaccacgtggtttctgaggatcctgtataccaattcgccaataaccatctgcattgtgaggagcttgaccaaaggtcaggacgttgccacccagattaatcagcccagctgccacacctattcttttcaagaagtcaacaatcttatctgctacatatcctttagcaagagcacccagatcaatcgccataccttcttttttcaaatagactgtctgctcctcatcatctaattcgatgtcccttggattgatgagctggagtttttcactgatcatttcttgggttggaagtttggcatcgctaaatccaatccgccaactttgcacaaggggaccgatggtaatattcaaaaaagatccctcagccagactgtgttctttgcccaattttatcaattcatacaggtcatcggcaactggaactgcttgaacaccagcgtttagattgacctccatcaattctgaagtcaaatcattggcagaaaaccggtctttataaagataaagtagctcttcgacctgatctaaaattggttctgcatctggatgccatattttcgtttcaatgatggttcccattagacgaagggaacggctacttgcttgcattcctcactacctcttggatttcttggtatatttgctcattttcggatagtgaataagagttagcaccacttgctagtgggtggccaccgccatcatggcgtttggcaatctcgttgattggaagatacttactgcgcaaacggactctgtaatttccgtcagtttgtttcacaaaaatcccccaagattgaacgattccaatccgtcctggagccccaacgataaaggaagtgtccgcatcggtcaccccgtatttttcgagaatgtcctgtgtcaaaataacacgcgccgcaccatgttcatccacttccaagttgtcgtagacgtaacctgtcaacttggcaatcttgaaatcaatggtatccatctggcgagacatccttgcaaagtcaaaatcttcttggcggagacgagcaacaatctcaaaggtgcgcgagctggttgccggatagagaaagcggcctgtatcgcccacaattcctgcatagagtagacgagcaatctctccatcgagttccagttggcattggatggctagttctgtaatcatttcactgcaagaactagcttccgtattgacccagagcaggtcaccataaggctcttcattggggtgatgatcgattttaatcaagaaatctccttgagcatagcggtcgtcatccacacgcgccgtattggcagtgtctgtcacgataaccaaagctccttgataatcttggtctgcaacttcatccattcctgccatccaagcaagatttggttcctcaaaaccggttaccttgatggtttttccaggaaaactcttctgtaagagtttctgcaagccaacttgactaccaatggcatccggatctggtcgtttatgtcggtgaataataatcgtgtcgtattcgtgaattttttcaataattttactgtaaattgtcatagcaactccttttcatcattttagcataaacttccccttttgaaaatgatgggagtgtggtataatggaattactatgtaatttggaggaaattatggcactagcaaaaatagtttacgctagtatgactggtaacacagaagaaattgctgacatcgtcgccagtaagctagaagagttaggtttggaagtacaggttcacgaatgtacgactattgaaaccgaagaaatcttggatgcggacctcatcgtggtagccagctacacctattcttacggtggagacggtgagcttccagatgaaattgttgatttctatgctgacctagctgacttagatttgaccggtaaggtctacggtgtttgtggttctggcgataccttctatgatgacttctgtagtgcagtagacgacttcgatgtcatgttgggttcacgtggtgcaactaagggtgccgaaaatgttaaggtagatcttgccgctgaagatgaggatattgttaaccttgagcaattcgcgacagaccttgttgctaaactagatacaatgaattaactgacaaacagactggcttatcaataggtctagtctgttttcttttagccttttattaagattgtacacctattgcttgcaatcttaatagttttgatatataattaactggttaattttttttgaaaaaaggagaattttatggctaaaaaatcaaaaatggcacgctatcagagacaattggagttaatcgagcgctatgcggatttacgtaaaagtctcaaagaaaaaggtgactatcaagcacttcgaaaattgcctcgcgactcaaatccaaatcgactgaaataccgcgacaagaccgatggccgtccgcatgcttatatgcgaaaattcggtgtgagtcggattaccttccgtgaattagcccatcttggtcaacttcctggggtaaaaaaagcaagttggtaacttcctcaaacaaggctagtattctgccttgttttttgctatactaaaaaacaactgaaacaatatacggaggtttataagatgaatttggattgcatccgcgaacagattaacacgattgatagccaattggttgaactacttgaaaaacgaatggagttggtcgaccaagttacagcctataaacgagcaacaggtaagcctgttttggataccagccgagaaaatgctgtccttgaaagagtcggaaaattagttcaaaaggatgattaccgctctgccattcaagcaacctttagcgatattatggcccaatcaagaacctatcaatcttccaaattagcgaatcatgagcaataagatgaaacatgccatccaactccttttcttttccagcttaattggagtcggtgcaggaataatcaccacactttttgggaaaattctactagggattggagacttacggtctgaatattttacatatctaatcccctttctgccacttgcaggtgtgttgattgttttcatttatcaaaaatgggggagggaagtccaagcaggtatgggcttagtcttcaaagctggacaaggggagaaagcgcaaatttctccagttctcattccactcatcatctctacaacttggctcagtcaccttgtcggtgcttccgttggtcgcgaaggtgtagctgtccaacttggagccagtctctcacactggttacaaaaacatggtttcacacacttgcccaaagatatgataacaaagattggtatggccgcaggttttgcagggttatttcaaacaccatgggctgctggtttctttgccattgaagttttaatcgttggccaatattcttggactagtctcccctattgtctagttgccgctttcacggcttctactacttcccatttactgggattggagaaattttcgcataccatcgctactacctcattctattttacagatagttttaaatggctatttattgccctttgcttcggtttcatcggcaatttatttgctttgtttctggcgcaagcaaaaagcatctcaactcgatggcttccaaatccttacattaaaatagctatcatgggagttggactgaccgttctactatttttcttccatcaaggtcgttatactggtctaggaaccaatttgatcgatgccagtttagctggggaacaggtgtttgctttcgattggctactaaaactcctactaacctgtctttgtttggctgcaggttttcaagggggcgaagttactccgctctttgcgattggggcaagttctggggctgttttagcaggattactaggtctaccaactgaacttgttgcagcccttgggtattgtgccgtatttggaacagccaccaataccttactggctcctctcttcattagttatgaagtcttcggcgctaatatcctgccctatgctattcctgtacttgccatagcttatcttataaacagaaaacagactatttatggacagcagttgaggaaattcaataatgcaaaaaagcctatcatctaggctttttcgtatactcttcatctcccctgcaggaatcgaacctgcaactaattcttaggaggaatttgttatatccatttaactaagggaagtctgcttctctattgtaccccagaagagagcagattgcaagagcaaggttatataagttttttcaaatctttacaaaaagcagaacctactctaagatgaaacacaattgtttttatgtatttctctcataatagtctctaaaagaagtaattctaaaatgtacttcgaaagtttgtcgtttttatgcttgattcctactccccttccttacgtctcactgagacagccattccgagtgaaactaagccacccaagctaataagaagtgagcctagggcttcttgaccggtatttggaagtgtttgatttcctgatgctttttcagttttcttatttgaaataggagccatacttccagatggtgccggttgctcggttgctttctgatttgttacactatcgccaccgtcatttgctttctcaggtgttttcacatcagtagttgtcccagcattatcttctttttcttctgcttttggttcttctacgtacttctctacaaatgcttttctacctggaattgttgcactaatggtttgacctgctttttctaaatcagtcaagtactccacaaatacttctgtatctggattgatagcaccaatcagtttagcttctttgaaaatcgagaagccatccccaccaccaaataagaagtcgttgatgacaagtgtataggtttctgtcggaacaatctccgtcccatcttctttgaaggctttaacaaccttataaggattttcttccgttggattgtcagccttcgtgtagatatatttaattccagacatttgaaggaaatatttttcaccttcatcatattgttgatttaaggctgtataaatctgctcacctgtcatttgaacgacttgtaggatattcccaaatggttgaacagcttgtgctgctccccaagtaactgttccatcttcttggaccttcaaatctgcccgaatcccgccatcgtttgtcattgcaaagtcaacatcataacccgatttcttagcgatagctaattgagccgatgttactagattacctacagcactttctttaaattcattcacttcgcgtgaaatatctgtcgcttgactagctgtagcaattttttgctcagttacttttttaacaatggtatttgcctcatctacaattgcctgaatttccggacttggtgttttctgccctggtgctactgcaataattttcgcagtcggaacagctttaaagtcggcaatatctgtatcataaacagccctaacatctgcgtaagccttaccttgtgaggtagcttgaacaatcaaggttttgcccgttgtaccgtttgtatagacatggttatggccagcaaatacaaggtcaactgagtgttcaggatagatttcatttagcttagcaatcatatctgcagcttcaccagcagccacaccatccttgcttgtagccggaacgtgagccagtacaactatcgcatttacacctttttcagctaattcacgcgcatatttagcaatcgtctctgcctcattcaaaaaagtgtactgctcatagtttttcttcaaaacaagattaggaatttctgtcgtaactacaccaataaagccaatcttagcttctttatcattcacgggaatagtcttaatagcgtagggcttccaaccatacggaatttcacctgtttctttgtcaataacgttagcaataacaatctcctgtttagcagcttcacgagtataattatctacaatctcattaaactgacctttttttggagcttcaccagtcatgatacggttatactcatcaagtccctcatcaaactcatggttccccaaagttccgtattcaacatccattttattaaagacttttacagttggttcatcttgcaaaagtccagaattcgatggacttgcaccaaccatatccccagcttgaacacggatagactctgcaggtgtctctgtttctgctgctgtttcttcaaattctgcttgtgaatcatccatgtaagcatcaagtaaagcggcagttcctgcattacgaactgtttccccttccaatcgcgctgtccccgtcatatcaagcgcaccatggaaatcattaactcccataatttggacagctaattcatctgctaaaacagcttgtgttgcaataacgctaaaaccagctacaagagctagtatactgcttttcaaccgaatattctttttcataagcaaaacaatgctccttctatttttttcatattgacatatctataataatccttttcttacggcttttcaatatcaaatcagtcatttataacaaaaaattataaaaatattcgtttattcttacttttacatcatttttctgaaaatatcttgtcatttttatctataatacgaaaattccccttcttcccttacacaattctctccaaaatactcctcacaactaaaaaatctcttccaaacggaagagaactgttcttatttagctgctttataaagttcgttaaccttgtcccagttgattacttcaaagaaggctttgatgtagtttggacggacattgcggtagttaaggtagtaagcatgttcccaaacgtccaatgccaagattggtttcaaaccttgcatgattggtgtgtcttggttagcagttgagataacttccaacttgccttctttattaacaaccaagaaagcccaacctgaaccgaaacgagttgttgctgctgcagtgaaggcttctttgaaagcatcaaatgaaccaaaggttgcatcaatatctgctgccaattctgctgaaatttctgttttttcaggtgaaagcaattcccagaaaagagcatggttcaaatgaccaccaccgttgttgatcaaagcttggcggatgtctgaaggaatttgctccacatctgacaaaagagctaccaagtcttcgccaatttcaggatgtttttcaagtgctgcattagcatttgcaacataagtcgcatggtgcttatcgtggtgaagggtcattgtttctgcatcaatatgtggttccaaggcatcgtatgcgtatggaaggtctggtaaaataattgtcattttcgttttctcctatactaagtgatagttctattctactccaatgtgagagccttttcaatttatttgtctgaaaccacggttgaccctcaatctaagaatactctttttactatgtagtcgcgatttttaataatagcaaatcaaataaataatccttatcaaattggccggttttaatttgaaaatctgtatcgattaggagcttgacgacttttttcaaaaatccaatggacagatggcgtgaatcacgcaaagcatactttacttggtatggattcaccttacgccccataatagttgataactcagctactatctgctgttcccctcggccttgctctagtagtatttgcacttgtagataggttcgaaattgggttaacatgatggcaatcaacttaacctcttcctccccttgcaaccgcaagtcacaaactaagttgcgagcatcgtctaccttggattgtagaattaactgtgttaaatcaaagatattatcttgtagtgtttttgggatagccgcatcaatatctgaaatttcaatcgtctcttttcccttataagattgaagaaaggctaggttcttactgatttctgcaaaatcaaaattggacttttctaaaagatattgaaaaacctctcctcccatctgcaatccaagacgcattatctccttttggaaatgatttttcaaatccatctccttcagaggattggcttctaatactagtccatctcgtttgaggagtttgaccagacggcgcttactgtccaacttacccggtgctagaatgaccaaacgtgttgtttcgacaggattttccaaataggcctcaaactgtttgagttcatcatctgtcaaatgccgttttttatctgtcgttaaatctgcaaaataatcaagaatcactactttttcatctgaaaagaagggaagagaaactaggtccaagtctacctgatgataatcagcctccgacatatcaaaataggcaaaacctaaatctgccgcatcaaaatgaagcttccgcagaagtaagtctttcgctatttggtattgtccgatgtcttcaccgcataaaacggtcagaagctctaatttctctttttttaatttttcaatctgttcaattactgtcataaaaacctcaaaattcttttctcattgtaccacaaaaagagcctagacataaagtctggactctttcattgaaatttatatcaggaaggtaggaaaaaattaattgataatcactccaaatgacctatttcccaaatagcagttcctttgttagctattccaccatcctttgaaattccaccaagtatcttgaaaagtatcctttatccgatctctccaagtcttattttcttcttcctcaatagaacgtttgaacaaggcatctgcgtactcatcctcttgttccttttgattctgttcaactcgtttcttttcgcttttatatactaattgaccaaaatacaaattcccatcgtctgcaaattttaatgtaacaacatcaccttcttcgagtttcttattcaattttacaacataatctccactgccgtccgcacgttccccacttgtataccactctctagtttggcaattctctgtagtataactcggacacttgagttcatgctttacaggctcgaccttcaatcgttctccatttatatatgtagcgacataaccaaatgagccaacatggacatgaatagagtctgaaccagttctaaaaggagctacttttacccccggaacattctgttgacctactggtacaaatattgaagtctccgcctttacacttgataacgatagtaaaccgatgacaaaggtaactaaaataaatgatacttttctcaatttcattttgcttttctcctagtagtacaatacattaaccggaattagtatataccaatttcatagagaaagcaagaaaaaacgctccttaagtaaaaactaaactcaaaaactcaattcttatccagcaccttgaaaggaatgtgggaataatctctgtgcgtttttaaaaattccaaggcttctttttttacctgtatgagattaacaccttgggcattggctccatagacacagccacaatagcactggcgataaatgtcatactcttcacacatttgaactgaacgctgatagcctccatttttcttaaagtcactcggaagatactgggtatcgtataatttctgcacctcaatcccaacagcattgatggtctgcgaattcttatgtggactgattgtcaaagccgaaccaaaatagtcaaaaccaagctcaactgccttctccgcagtcttatccaaccgataatcatagcaaaccttacaccgatctcctccctctggctcattggcgagatgctgagttttcttgaaaaattcctgagggctatagtcagcttctaggtagcctactgactgtccagttttctgattaaattctttgacaaactgggccgtcacggctgcccgccgctggtactccgcctttggatgaatattggaattcgcaaaatagatggttacatctgcatattgagtcaagtactccaatgtataggtcgagcatggggcacaacagacatgcatgagaatgttcggtcgaagccccgcttcctgccacgtgcttgccattttttgaaacactttatcatagttaaccttttgattcggtgatagagtcgataaaatctcttcaactttaatcatacaaacctccaaatatacattcattatactatatttgaagcctactgcatagatagtaataacgagggagagcgcttgataaggatccctatttccaacttaaaaaggtccctcggaccttgatataaagaaaaacgcctgccgacgtttctcatctccagcttaaaacgtggggtaacccacttgtaaagaaaaccgcttaccagcggttctcatttccaacctaaaacaacccgtcaggttggggacaaaccagcaacatgcattgctggttttcctatctcccgattaaaacagcctatccgaatataaaaaaactgcctgccggcagttctcattttcaacttaaaacgtggggtaacccacttataaagaaaaccgcttaccagcggttctcatttccaacctaaaaaggtcccccggacctttttagccacccagatatgcttttttgacttcttctgaggcgaggagttcttttcctgttcctgagaggacaacttttcctgtttctagaacatagccacgatcggcaatagcgagagctttgttggcattttgctcaatcaagaggacagttgttccttgtttttgaatatcttggatgatatcaaaaatttcttggataaagatcggagccaagcccattgatggttcatcaaggagcaagagctttggttggctcattagggcacgtcccatggccaacatctgttgctccccacctgaaagggtagctgcatcctggtttttacgttcttccaaacgtggaaaacgagcaaagatttttctcaagtttgcttggttttcttcacgattgttgtgaaggaaggcacccatttccaagttttccataacagtcaagcctgcaaaaacatgacgaccttctggaacttgtgataaaccgtccgccacgattttacgagcaggaactttttgaatctcatttccaaggaaagaaatcgttccagctgatggacgaacaagccctgaaatagtacgaaggatagaggttttaccagcaccattagcgccgataagggttacaacttcaccttcattaacctcaaagctaacatctttaacagcttcgataacaccgtagttaacggaaagattttttacttctaacattgccattaagcttcacctccaaggtaggcttcaattacacgcttgttattacgaatttcttctggtgtaccatgggcaatcaaacgaccgtactccaatacgtatatccgctccgtcacttccataaccaagctcatatcgtgttcaatcaagatgatagtaatgccaaattcttctttgattttacggatgagttgggtcaattctgccgtttcttgtgggttcataccagccgctggctcatccaagaaaagaattttcggttcagtcgcaagggcacgaacgatttccaaacgtcgttgttgaccgtaaggaaggtttttagctaatgtatctgcatctccatccaaatcgaagattttcaaaagttcaatcgcttttgttttcaacgcttcttcattcttatagaatgctggaagacggaagaaacttgcaaatacttctgatttaccatggttgccaagaccaatcaaaacattttccaaaacggtcatatttttgaacaaacgaatgttctggaaagtacgacctagaccaagcgaagcaatttttgatggtgctttaccgttcaaaatagtccctgccagagaaattgtcccctcgcttggctcataaacacctgttaagaggttgaaaagagtcgttttaccagcaccgtttggaccgataagaccaaccaattccccttcatgaagttccatggtcacgtcaccaacggcagtcaggccaccgaagttcttggttaaatcttttacttcaagtaatgccattacttaacctccttcttcttgagtagagccgctacgctgaattccttagttcccaaaagacctccaggacggaaaatcatcaagagaataagagctaatgaatagataatcattgaaatatcagagtaactcttgaggaatacgttcaaaataccaagtacaatggctgctacaaaggtacctgtgatagagcccaaaccacccaatacaatgataatcaaaacgttaacagaggtcataaaggcaaagtctttcggaacaattgtcccaacgtatcctgcatggagaccacctgcaatggctgccgtcatggcaccaaatacaaaggctgaaaccttaacaaatgttggattgacacctacagattctgccgcaatttcatcctcacgaacagaaattgtagcacgtcccatcggactgcgcaaaaagttaactgtcaccaaggttgtgatgattacaaaaatataaactaaaggccagcttgtaaagagtggtatagacataatacctgctgcaccattcgttacactaccaccattgataattaaaatacgaataatctctgcaacaccaagagtcgcaattgcaaggtagtcacctttcaaacgaagggttggaataccgactaaaagagctactgcacctgagattaacatcccaacaatcaaggcgatagcaaatccaccataagtcggcatcattttcccaagaatacctactgcataagcaccaatagccataaaaccagcatgaccaagtgaaaattgacctgagaaaccgacaatcaagtttaaaccaactgccaagataatttgaataccgatttgctgaacaatctggatgtagtaaaaattcagaatccctgctgatacaagaccttgaataagtccaaaaccagccaataagatagccaaccaaatcgcattaacttttaaattttgcttcatggttacaccttctctttcacatttttaccaagaataccacttggacgcaccaagaggatgatgatcaaaacagtatatacgatcgcatcgcggaaagtatcgaattcaatcacataggtgaatgtttcgatgataccgataacgaagccaccaagcgctgcacctggaataataccgataccgcccaatactgccgcaacaaaggctttcagacctggcgtcatccccatcaaaggctcaatctggttgtagtagagacctaggagaacacccgcagcacccgcaagagctgacccaagagcaaaagtaaagctgattgtacggtttacattgatccccataagctgagctgcatcgctatctacagagaccgcacgcatggctttccccatttttgtacgtttgacaattaattgaagtgcaaccatcaacgcaagcgatacaccaagaataatcaactggatattcgtaacagaaactggaccaaggttaaaagtcacagcttcgattgcttgtggaaaggcttttacgtctgctgtaaagaatttaatcatagtgtattctaagaagaaggatacaccgatagccgtaatcaaagctgctatacgcgttgaattacgcaaaggacgataggctaaaaactctataactacaccgagaatagccgtccctaccatcgctagaatgagagcaacaaagaaacgcgttccaccatctgcaataaaagttaaattatttaataggaagtaccccataaaagcacccatcatatacaaatcaccatgggcgaagttaatgagtttgataattccgtacaccatggtataaccaagggccaaaagggcataaacagaaccaagaatcaaaccattgacaagttgttgaagcataggttcaccaatctttctaaatatttttcgagctcaatagcattgttacattatacaaaattttctgaaaataagcaagttagacagagagtttaatcattaaaattacagaaaatttaaccaacccaaatttaaccaaattttatatccgcatgtatactattctatacattctgacaagtgaaaaagagggaattccctcttttcatccactattagtcaatagagatagtatctacagatgattcttctccgtttgttaaactaacaacataaactgatttaatgacattgtgctctttgtcaacagacattgtaccagtcacacctttaaagtctttcagagctgcaagattagccttcactgctgctgaatcagctgcaccttttgctgcttctgctgccatgtaaaccgagtcgtaagctaaagctgagaacattgatggctcttcattgtattctttcacataggcatcatagaatgcttttgctttttcgcttgctgatgttacaaatccagaaaggtagtaaacatttgatgctgctgatgcagttgccaattcagtaaattgtggtgagtcaaaaccatctgaaccaagaattggcttgtcaatacccaaaccgcgtgcttgcttcacaattgtacctgtttcattgtagtaaccaggcatgatgatcgcatcaaattccttatctttcaattttgtcaaagcagcttggaaatctttatcgccagaagcaaatgtgatttctgaaacgatttctcctgtgtatgctttcttgaacgcctctgctacacccttaccataatcagaagagttgtcaaagtaaagaacaactttcttagctgacaagttctcagtagcgtatttagccataatttgaccttgatacccatctgtaaaggttgtacggaagaagtattcttggacctcacctttatcgttcacaaccaaggttgtttgagttcctgaaggagtaatcataggaacaccagcagatgtcaatgctggaatagaggctgctgaagctcctgatgtagcagggccaatcacaacgtttgccccttcacttgccaagcttgttgcaacagtagctgcctctgctgtttcagacttgttgtcttttgtgatcacttcgatttttttgccgtcaataccacctgcagcattgatttctttcacggcaaggttggcacctttttcctctgtttgaccataagatgaaacagcacctgacaactccaagttgtagccgattttaaatgtatcacctacagaagaacctgcggctgaagtattggttgtcgaaacattaccacatgcagcgagtagagctgcagaggcaaatgtagcaagcgctactgcaaattttcttgttttcatgaaaactccttaaatctttcttaaattttacgatgtatctaatatactgaattatctgaaaattgtcaacaaaaaagaaaaaaattttaaaataaaaaattagcagggaatacatacctgctaattccgactatcctacgactgatggttcttcatctctccatagattacctacaaagttttggtctaattccttaatgtatgaaggaaccactttttttacaaaacgttcctttttcaattttaatatggtagcttctactagttcttgatccatatacaccaaaacatatcgcaagcgtttggaatggtaaacaatatctccatattggctgagtttacgtgcatcacgattgtagtgtaaatagacagttaagcaagtgcgatttttcttctcaaacatgtcttctcctctaaaaattctctttctatattataccgttttcaatgataaatgaaaagctccaactacctgtaaaagagttggagctaataggaatagtcagtactattacatatttgtcactgcttatttgacttttgtattgtccataatctggtcaataaatccgtaagccaaggtttcttcagctgacatccagtaatcacgttccgcatccttgtggatttgcttgactgtcttacctgagttgtctgccaagattttttctagcttattacgtgtttttaataggtgttctgcagcaatagccatatctgtttgctgagtaccaccaccagttccacccattggctggtgaatcatgtactctgcatttggcaacatgaaacgtttgcccttggcaccgcttgatgcaatgatggttcccatgctcgcagctgttcccataacgatggtttgaacatcagctttaatgaaattcatcgtgtctacaatggcaagacctgctgacaccgatcctcctggcgtattaacatagaggtaaatatcctttgtagggtcttgggcatcaaggaaaagcaattgtgcaatgatagagtttgccatgttgtcctcaactggtcctgtcaacatgataatacggtctttcaaaaggcgtgagtaaatatcataagaacgctcaccacggctagtttgttcaataactactggaatcataaaattactccttttcgagattttctgtacccattatatataaatagtcaaaattggtcaaataaaaaacacgatttcaggaaatgaaaaagaaaccagcagagctgatttcttaattattttgtaccgaacaagcggtcacctgcatctcccaaacctggtacgatgtagcctttttcattgagtttttcatccaaagctgctgtataaatatcaatgtctggatgtgcatcttgaagagcttttacaccttctggagctgaaacaagagcaacaaatttgatatttgaagcaccacgttttttcaatgaatcaactgcaagaatagctgaaccacctgtagcaagcattggatcaactacaaaaatatgacgttgatcaatgtcttctggtaatttcacaagatactcaacgggttgaagggtttcttcatcgcggtacataccgatgtgaccaactttagctgctggtaccaagcttagcaaaccatcaaccataccaacacctgcacgaagaattggtacgatagctaattttttacctgcaatttgtttctgaactgttttagtgattggcgtttcaatctccacatcttcaagtggcaagtcacgcaaaacttcgtaacccatcagcatcgcgatttcattaaccaactcacgaaaatcctttgttgaagtagatgtacgacgaaggatagacaacttatgctgaatgagtgggtgtgaaatgacttggaatttccccatgatgataaaacctctcttttttgttttttctattttaccaaaaaaattgaaaaaatgcttgagaatatggcaaatttatttattttttgaaaacgatagcttcaaaaggtctcaacatccctttattaatcgcctcttcgttttcataattgttcatgaaaatagaatattcttccacagctatagtataagcctgttcctggcttgaaaagtttaccaatatgatgaaatcatcctgttcatcatatttacggtaggccattaccgagctatttccagtctccatcacttcatattttccttcagacatacaaggatactctttccgaagagcaattaatttttgataggtataaaaaagtgattgtttgtctgcaagtgctttttcaacattgatgtctttgacagtatctcccaaagccagccaggcttgacctgtactgaagcctgctccttctgcctctgtccattgcattggacgacgagcattatctcgacctttggcatttatagaagtaatcaattcctccttggtgaagccattttcaatccgttccgcatacatgcgacgtgtttcaatatcgtccgcttggctaatatctgtaattggcgtattaatcataccaatttcctcaccttggtagatataaggtgtccctgacataaaatgaagatagatagccaacattttaccacttagttcacgaaatgcaggtcgatcatcaccgaagcgagaaatggcacgaggtaaatcgtggttattccagaaaagcgagttccagcctttaccaaccagttcagtctgccatttggagagaaccttatgcaaacgtgctggatcaagcggtgccaaatcccacttttctttcccttcctgctgatcaagtccgacatgttcaaattggaaaatcatcgaaaattcttttctgtcagggtgtgaatataactgagcattttctggattggcactccatgtctccccaacagtcactaagtcgtaagcaccaaaggttttctcatttaattcctgaataagaggatgaagagtcggtccatcggctgtaattaatttttctggttcttttccaatcaaatcaatcacatctagcctgaaaccgccgacacctttttcaatccaaaaattgatcatgtcccagatttcttgtttcagagcaggatttttccagttcagatctggttgcttaacagagaattggtggagatagtatttgttcagatgtggaacgtattcccaagcagagcctgagaaggtcgagcgtaattcattcggttcatcagcccaaacataataatcataatagggattatctggtcctttgagggcttcttgaaaccagaagtgttcatccgaggtatgattgagcactaaatccatgattattttgatattgcgcttatggccttctgcaatcagctcttccatatcttccatggtcccaaattctggagcaattccttggtagtcactgatgtcgtaaccattgtcatccatgggggactgataaacaggactgagccaaatagcatcaattccaagctcatggagataatctaatcggctgataatccctcgaatatcccctactccatctccatttgaatcttgaaaactacgaggataaatttggtaaatgacggacttcttccaccaatctgttttttgtatttctggcatttgattgatcctttctgtacaatcttattaatgtaagaaaaagaggtgtccccctctttctatataatcatattataactcaattgtggtaatttttccctcttcaatttcaacaatttcaaaggatttttcttttaggtttgctgttagacgggcagacacccctgcatcttgattattccagaaaatttccatacttgtttcatccaacatcttaacagagaactccccgtcgaaagctggacttgtattgcggaatttaaggagtttgaacaaggattgtacaactggccgttgcacttcctgctcaatttcttccaaatcatagtaatggcgattgatattgcgcccttccttacttgattctaaaagttcaatatcattttcgcctgctagtaaaccaacataataaatctgtggaatacctggtgcaaagcattggagaacacgcgccaatagataagcttgatcattattgccaagagcagaataataagtacagttaatctgataaatatccaaattattataggcttctgtactataaattttcttcacattggcaccttgtgcatacaaggcttcacgggtctcctctgtctcctcatccgtcagcaaatccttaacatccacaacaccgattccatcatgtgtatcaagagttgtaaattgcttgcgagggcaaatctccatccagtgaaccaggcgattgacatgaccagaatacaaagcgtggagaactagcattggcaaggcaaaatcataaacataataatcttgctcggcaattttctgctgaatggtgtagtgttcatgaatttctggtaagatttctacatcttttggtgccaataactgacgtggaaaatggagcatttcccaaatatcaggctccacaaagaaacaattggttccgatttttttattggcataagcaaaggcgtccaaacgaataatcgaagcaccatgctctgccaactgttccaaattttcttggatgaaacgacgggttgtctccgttgtcacatctaaatcaatctgctgttcatcaaaggtacaccacaccttctcttcactaccatcagcaaatgttgcaattcgataaggtgcgcgaggtttacgcttataaatcaaatcaacatcttcttgcgttggctcaccatttggccaaaagtttttataacgaataaacaaatccgcataagctgattcatctttcttttcaagaaaatcaaggaaataaggagattttgctgaaatatgattgatcataaaatcaaacatgaggtaatagtctttgcttagtgcttcaatatctgaccaatctccaaatgcagggtccacctttgtataatccattggcgcaaacccacggtcacctgatgatgggaaaaacggcagaatatggatacctcccacaacatcctttaacggcccctcaagaacttttttcaaatccttaagattcttgcctaaactatccgaataggtaattaacatagcttgatttttaattttcatagactttctcctttgtaagccttttcttttttgttattttataaaaggttgaactagtcaaccttagtaattatttgacagaaccacttgtcatacctgaaataatatgtttttggaagatgaggtaaacaagtaagattgggataattcctacaacataggatgcaaatgatgggccatagtcactaaaatacataccttggtagttgtattggaaaagaggtaaagtccacatgctttgatcacggttcaatactagcaaaggcaagaggaaatcattccagacccagagggcattgataatcaaaacagttgcatgcatgggtttcatgagtgggaaaatgattttccagtacatggtaaatttatcacagccatcaatagctgccgcttcatccatttcttcaggaacaatggtcttaatatagccgacgtagaggaagagggcctgaggaactgcataggtcaaatatagaataatcaaaccgacaatattgttcaaaccaaggcttgacattaatttggtcattgggagcataatcacttggaaaggtacaaaaatcccaataatcaagaaaaagtagataaagttaaacactgtctggcgtttcatttgacgggctacggcgaaagctgccattggaataacaagtagaatcaagccaacagctacaatcgtaatcaaggcagaattgccaaaatattgtacaattccatcattaaacaagcgttcgtagttatttaaggtgaaattttcaggaagaccaaagaaattgctggtaatttccttggttggtttgaatgagctgataatggtcacgagtagcggaataaacatgaacaatatcccactaaagagaactaagtaaacccaccaatttttctgtttttgagtattcatgtctgtcctcctaaatttcaaatttcttcgaaattctcatctgaatcaatgagatgacaataatgaagatgaagagtactacagccaaagcattggcataagagaatttgttgtctacaaaggcatagttgtaaacgagtaaacccaaggattctgttttgccgtctgggccaccacttgtcagtgcaaagataaggtcaaatgctgtcaaacctgacttcattgccaagatgaaaaccatactgatagatggtaataagaatggaagctcaatgttgaagaactgttgagaacgacttgcaccatcaatagctgctgcttccttcacatcttctggaatactttgtaagccagacaggaagatgatgactggcatagccaatccttgccagagagccacaaaaagtacagctggaataacagtattttcttgtaccaataagttttccatcaaccaatcgatatgaaggatttctccaatctgtgtaaaaccatagttgaacaattggacaaaaatcaatcctaaagtgactgtggatagcactgctgggaagaaataccaagttctaaagaaaccaactgctttaatcttacgattgaggagactagccaaccaaatccctataacaatttctccgatgaccaaaccaatggtgaagataatggtaaaagtcatggaagtataaaaatcaggattttttaaaatatctaagtaattctgaataccgattagtttgaaatcagatgtcaatccattccaatccgtcaagctataatagatacctgtaaatagaggatagaagaaaaagattaactgtaagccaattggtatggcaacaaatagatagggccaatatttggcaataaatcctttttgattcatcatggtactcctttttgataaagttatagttgcttagtctcagttcaaggaatcccatagggttactaaaactgacactaggcaactataaggaggctaggctacaactagcccctgcttatagttttcctggattattttttcattggatcaaagaatgcgttcagttttttcactaattctgctgagttaggatttttaaccatttcaacagtgatgttccagaactcctcttctgattcccattcagattgcaaccaaactacgtgtttgtcagtgaaggcatattgtgtcactccagcagtttcttcaaacttaccttctgtatctacaccttcaactgaagttggtgagccatctacatcatagtatttctggataacttctggacgagagaggtattctaggaattttttagactcttctgggtgctctgtatctgctgaaatagatagtgcaagatcagctgcaccgatggtatagtcgccaccttctttatcaccagggaatgtaaacataccatattcaaattctggttcttgttggtttacagctgtagctgcccatgtaccttgtggaagcatgagagcatcacccgctgcaaaggctgccaccgcatctgcatagagcgcgcctgtcgcccctttttgtccattgtctttcaacaattgcaagcgttctaaaactgcttttgttgtagcatcatcttgaatcgctccctttgcactacgaatcagaatatcttctgcaccatcaaatccacccgcaacagttacccaagctaactgatggtagccgttcaatgaccaagcatcgttcaatgaaagagcaaacggtgctgcactgccatcagccttgattttgtctaccaaagccacaaattctgcataggtagttggaacttcgagccccaattctttgaacttatccttattatagtaaattccgtaggcattagctgtcaaaggaagggtataatttttttcgttaacaagatatggtgttacagcaccatctttcaaatgatttaatcctgcatcatcaccaatttctaggaaacgaccatccgctgcgtatgctttgaagtccgcattttgtggataaatgttgatgacatctggcgcttcgttatttgccatacgggttttcagaacagttcctgcatctggtacatttgaaaatttaacatcaatcgtaggattttccttttcgaaatcatcaataatttcctgaagggtagcttgcatttctggtttttgtgaaaaatattctatttctaccttatcgctactacttgcattcccacaagcaaccaaaaagctggcaaaagcacaaaccgatgcacattttaaaaatgttttcattttcattataaaatcctcctagattttgttaaaaatatattgtacactaaaataatctttttgaacatgtggcattgtaagaccaatgttcatcagttcatccccgtagaatgtctctcctaattgtgggcattcatacaaggcatctgggtctaaccccttcaaccgaacatgaagcaaaggcgcttctggcttggcaagaatttttacaaatgtaaagaccacttgattcttatcttgactaacataattggcagcccaggtattgctcgtctttttcagacggtagagctgaccgaattgtatagtttcacgaatggagtgataggtttcgatttgctgactgatttcatccaattccttttccgaaagtttcgttaaatccagctcgtaaccaaatgctcctcccatcatagccacattgcctcgtgtagcaagaggtgtgatccgaccaacctgatggtttggaacggcagaaacgtgtgcaccaattgaggaagggggataaatcaaactagtaccttcttgaatagataagcgctcaatcgcatctgtatcatcacttgcccaagcttgcggcatataatacatgattcccaaatcattacgacctccaccgcctgcacaggattcgaaaagaatatccgggaaccgctttgtaaggtggtctaatacacggtagagacctagcatgtaacgatggtggaactcaaagcgctggtcatttgctaaaccttcaggaatattggtgatattacggttcatatcccattttacataagaaatattggctgattctaatatggaagagacgctatcaatgatgtagtcacagacttcctgcttggtcaaatccaaaactaattgttctcggctgtagattggtaagcgtccttctgtccgaattgcccaatcaggatgctcacgataaagatcgctatcaatagaaatcatctctggttcaaaccacaatccgaatttcataccaagctcatttattcgctctgctaaaccattcaaaccatttggcaacttatccaaattgactttccaatcgcccaatgaactttcatcattgtttcgtttaccaaaccaaccatcatccagaacaaacaattcaataccagctcgacttgcaacctgagctaactgtaaaatcttttcttctgtaaattcaaaataggtcgcttcccagttgttgattaaaatgggtcttggtttgtttacaaacgatgatcgaatgaggtgttttgtgataaagtgatgactattttgtgtcatgccagtaaatcctttatcagtatatgataagagaacttctggagtttgaaaccggtcatccttatccaattgccatgagaaatagtgactttccaatcctagtcccaaacgactggtttccatggctgtcgtttcgacaaatgctgtaaagttgccgctataaacaaggtgggctgcataaacatcgcccttgtcctcacttgcatcgggtgaaactagtgctaaaaagggtgttcttgagtgacttgaagcacctcgaatgctaccaatcgaatactgaccttttgtcaatggggtctgtgtccactctttttcataagcataacgtcctgccaagctgtgaacaatgaaatcctgatgtggaaaatcaagcgttgcagacaagaccttctctagtttgcatggatatttgccagtttgaattgtagctgaccgtgcgagataggaagcttcttcaaaaacagaatactgaagagttacggtaatatctgtcaactgatcgtaaagatcaatttcaagactctctacctcttcttgatttccaaaacttgctggtaatcccctcagttcttttttccccttgtataatcgatactctttgtattttaggtcaagagtgactccaaattcattccgaacatctaatgctgaggttctaaaatctcccagaccattgctggaatattcgagtgggaggacatccaatgagtatgtcctatccccagtaattggcctcggagaaaacgatcgatctaaatatgttattttgtttccatcgctaaatttttcgatttttttcccaaaataacgatgaaccagatcgcctgtttccaatacttggatgatataagagaattctcttgttttcaggtgaaaaatctgtttttcattataaatctcaatcacattcatctctcctatctcttctttatggtcttattgtacaaaatgaaaacgctttatttaatggtcttttgtatttaaaacatgttataatgtttcctaggaggattgaaatgaatgttctaaatatctataatgaattggatagtcataattttgacctaaatgtagaccattacggtgccgaacaatgtgacaagggctattccttcggtcctactatccgtgataattttgtcctacattttattacaaaaggaagaggaaaaattcttgttgacggaaaaacaagctatcttgctgcaggtgatttgtttattctgccaaaggatgtttccattttctatcaagctgatgatatagacccgtggacctatgtatgggttggttttagtggttcacgagcaaaagacctacttaatcaaagtcaactgctagaaaactactacctccactccaatctagagtcaccaattctaggctacatgcatcagattaaccatgttcagatgcatcccatcccctctatcacagaattggtcttaattggctacctcaaccaactcttagcagcactcatagaggaatttcccagtgaaacattaattaagcctgaaacacaaaccaagcactatgttcagcaagccatcaagatgatccataaccactatgcccatccaattaaagtttctgaaatagcagattttctagctttaagccgaagctatctctataaaatttttaagcaggaaactggctattctatcaaagattatattttacaagtaaaaatgaatcgttcttgccaactattagaagatgcttctcggagtatcactgaaatcgcctattctgtcggataccaagaccctctcaccttcagcgcggccttcaaaaattatttccatataagcccgacagaatttagaaaaacacaaaaaaataaggattaggtgattttactcacacctagtccttatttctttatccaaaaaccttaccaagtcgctgacaggcttcttcaatcatgttgaatggtgctgctacattcagacgtgcatggtgcttaccttccttaccaaaggtcaaaccatcattcaaaatcaacttcgctttacaatgaagaatatcaaagagctccgcatactctaattcataggcagaaaaatcaagccagatgaggtaggttccctgaggcttcatgaccttgatccttgtatgggttgtcaaatactcctcaacaaagtctatatttctctccaaaataaccttcaactccttcaaccactcatctccataagtgaaagcagcttctgtggttaacaagccaatcgttggaatctcgtgctgattatttatcaattgacgcttagcgaaagtcttgcgaatacttggattttcaatgattgcaaagctattttttgtaccagcgatattgaaggtcttggtcgcagatgataagatgattgaaaactctttaaaactttcatccactgtgttaaaggaataatgcttgtgaccatacaaggtcaaatcttgatgtatttcatctgagacaaggataacaccatgtttctgacaaagacgtccaatggccaacacttcctctcttgtccaaactctaccacctgggttgtggggattacagaaaatatagagtttcacttgattctctacaatgtccttttcaagctggtcaagattaagcctaaaaatactatctacatcaactagtgaattggtcaccaactgacgattgtttaattttacagtccgcgcaaagggtggatagacaggtgtattaattaggactgcatccccttcttctgtcaaagattgaatagccacagataaggcaggaacaactccttcaatgagtagaatagactctctttcaatcttatagccatgctgtctatcttcccagtcaataatagactgatagaggctgtcactagcatagggataaccaaaaacgtgatgaactgcgtagtcacggataacttggcgaatttctggtagaggctcaaagtccatatctgctatccacaagggtaagagttctttatccgtctctacttgtctccatttttccgcatgctgggatagacgattcggactatctataaaattatactgtgtcatatcttatccctccaaggctgtctttaaatctgcaatcaagtcttccgcatcctctataccaatagacagacgaagcaaatcatctgtcaaaccgtaagaatgacgggtttcagctggaatgtctgcgtgggtctgagtggctggataggtaatcagactctctactccacccagactttcagcaaaggtaaagactttcagggtgttgagaatatggggaatccgactttcatttaccaccttaaccgaaatcatcccaccttttcctgtgtagtaaacttgcttgactgctggactcttctccaaataggcaacaattttctgagcattttgtgtcgcccgctccattcgaagcgagagggttttgagtccacgcatgagtaagtaagaatccagtggagatagggttggacccgatgtattttggtcataaaagagcttatcatatagggcttgatcattggtcatcaaagcgccagctagtacatcattatgcccagataggtacttggttgctgaatgtaggacaacatccgctcctagaacaagtggattttgataaatagggctgtaaaaagtgttatcgacaatcaccttaacacctttggcatgggcgatagccgaaaccttagcgatgtcaaactccaccatgagtgggttagtcggtgtctccagataaacatagtctgtctcttcggtgatggctgcaatcagctcctcctcggtgtttgcataggtaaattgaaatctaccgatactctcttgctcattgaaccagcggaaggaaccaccgtacaaatcacgcgccgctaccacttgactccctacaggaaaaccattaaaaagtaagaccagagcagccattcccgagctcgttgctagggcatagtcggccttttcaatagctgccaaagtcgtctctagactggcacgtgtcggattttttgttctcgtgtagtcataacctgtcgattgaccaaactcagggtgttgataggtcgtcgaaaggtggataggggaaatcaaggcacctgttctctcatcgctattgatgcccgtatgcgctaaaatcgtatcaatcttataatctgtcataacatctactccaatctaacttacaatatagtctagcatgaaataggagatttggtgtgaaaaatatccaaaaatacttatagaaaaatagcaagctttgttatagtttttctttataacaatatccatactggatctaccaataaatacttttaaacctataatttatttgatataataaaagaaagagaggtgattgtcatgaaattccagtttaacaagcatttctatcggtatagtgccttctattctatgattttttggacttgtttttttctgtcagacattttgctagacccttcccaaactcctgcatggtatagcctactagcctgtctgattatttttatcaatgccatttgggtattcttcttcaaagaagaaaaggagctcactcgcatgggttacatcttctatatcggattgattgtagtgattgtttatctgagatttattttaggtaagtagaaaggagtttactatgtctaagaaattcaataaagcattctatcggacctgggaattttacttgtctcttgcctgtatcctacaagtgatttatgctgctgtaaacggaccgttttggtttatccattttctcaagcttggagtcggactttatgctggttatctagctttctttaagtcacgtagctggataaaaaaaacatggcaaatttatctgacgattggattgattgctagttggataatcatttccttctttgtattgtgaggattttatatgtttaaggaatttaataaagaatattatcggagtttgaatttttatctgatgatattgttgtttctaggaagtatcggggagtggctaaataagggacctagcctctggcttgcactcttgctctttgctactgttggtactgcccgtagtgccttttggtctaaagaatggaccttaaaagcaaattggcaaatctatctctgtatcgccttcttgcttgttggagcttgggtagaattttttgtttaagagttgggagtgggaaagaactcgactaagtcaaaaagagttcgtattcccacccccgcacagttgattaggtcagatttggagtgtaaaacacgaacaaatctgccaatcaaccactgcgctgagatgttgacacgaacactgagaagtgggccagggctttttgcccagcctcttttctttcaaaataaacagtgattttcattcaaagatggtataatatacctatgcaaaaaattgatttactagacggagagcggattgaccagctcttctcgacagatgttcagattattcaaaatcgggaggtatttagctactcgattgacagcgttcttctttcgcggtttccaaaaatgcctgctcagaaggggttgattgttgacctttgtagtggaaatggggcggtgggtctctttgcttctacacgcaccaaggctcagattattcaggtcgagttgcaggaacgcttggcgaatatgaaccgccgctccattgccctcaacggtctggaggatcaggtttcggttatcaatgacgacttggcaaatctaccccaatatgacctacggtccaaggttgatttgatgctctgcaatcctccctacttcaaggtggataaagagtcaaacctcaatgaaagcgagcattatctcctagccagacatgagattgcaaccaacctagacagcatttgtcaggtggcccaacaggtgctcaagtccaatggtcgcttggccatggttcacagacccgaccgatttttagatattttagacacactaagaacctacaaattggctcccaaacgcatccagtttgtctatcccaaggccagcaaggaggccaatatgttgctgattgaggctatcaaggacggctcggtggacgggctgcacatcctgccacctctggttgtccatgaggaaaacggcgactatacacctgccattcgtgagatttattatggaaaataaggcctacttgtatgttttggaatgtgccgacggaagtctttatactggttatacgactgatgtggagaagcgacttgctacccataatcgtgggaaaggggccaagtacacccgcgcacgcttgcctgtcagcctgctctatcaggaagactttgacagcaaacaggaagctatgtctgccgaggctttgtttaagaaacgcagtcggcagagtaaattagattatattgcagaaagaaaacaagaaaatgcaaaataaaaaacatatccaccgccttcgcatcatttggcatatcttgagagtgactggttttgccacttttctcacttcctttttcagttttatctttctagcagctggtttgctactctggttggagcctgattttaccagctacggtgatagtttatggtacagctttgtaacggcgacgactgttggctatggagatatgctggtcaccactgcttttggacggattatcagcattatcttagctatttacggcattctctttttggggagcctgtctggattagtcgtcagctactataccgaggtcagcaagcattattctttagcaatcaaacaggacaagcaaaaaactggctcttaggaaccagttttttaatagctttccaaaatctgatcaattttagccattgcctcttcaaaaataacctgagactgacttggatcggcagattgcccttcgataaagacctgatgaatgtcttcaaatccaagaaactcaaagatagacttgatatattgggcagctggatcttgacctgcataaacaccaccattggactggatgtgcaacaattttttgcccttgaccagaccgatagagccctcaggtccatacttgaatgtcagtcctgcaacgttaatggtattgatccatgacactaattgacttggcacattgaggttccaaaggggattgaccacgacaatcttatctgctgcaagaaattgttgggtcaaggcattgtagcggcccaactgctctgcttgttcagggctgatagcttcgcctcttttagctgctcccatagcctctaacaagggcttatccaaagctggtatttggtcctcaaagacatctactatttcaatccgatcttctgggtgcaaactggcgtaccgtgtttgaaactcttccaaagcccgcaaggcgtaggacttttgtgcgtcaagtgggtgggcttttacgattaatagatttgccattggttctctcctttgttatccgttattactaattattgataaatatattctactctttttgatttgaaattcaaatcatttgctcgaagcaaaaggctggtctcccagcctctgcttttttagattgttttattattttaaataggtgtaagcgacacagtccaggctatcaacggctgtaaagccaattgcctcatagaaagaccgtgttttctcagtattgtccgtcaagagatgaagctgataaatacccggaaagtgggtaacggcctgctccaaaagctgacgcccaattcctcgtcgctgataggttggtaggaccaagatgtcctgaataaaaacgattgaatgcccgtcgccaactgctcgcaagagacccactagacggtcaccgtcaaaggtagcaagaacgagcagactatgttccaaggccttctctagcatttctggacggctagtatatcctgtccaacctacagaagcatagacgtcaaggacagcttgaaaatcgagttgaggattttgtttgtaagtaatcatgtctttctcctttgtattgttttttagaatacaaaggctttgtccattgttaaaacgcccatggtctttcctcctgttttgctacatttagtataacaaaaactgctccaattatgaagcagttttgtaacgacgataaaaataatagagactcaaggttatgacagatgtaccaaacaaaatcagcacaaggatagatagggttggtgagcctaatagactaactagcagcaataacccaccaataatgaagagatagcctgactgctttcttccctttcgttctatttcattggtcttgctatccaattcctccttgggtaaataattccctattaccatatagccgatagccagcagtccaatgacaagcctacggtaatccaattctccgcctaaattataccagagtaaagaaacttgaatgatgagagccagtagcggaaaaagccatttgaacactcgaatgactggtgttttccctatccctttcacatcataaagcacacaaataaataggtgaacacaaaagaatagtagcggtgtcaaaattgtcaccatatacttagccatagagccatttggctcaccatttacgccaaaatgcgttaccatggtatctggcaatgctccatagtaataaatcgtcaataaagcaatcagtaggaatataccagaagttgcaaataaggtttttatgtcaattttcttcatcttgttgccctccaaaacttgcaatccaaaccaagacttcttcaaagaccgtatagtttagacgataataaataaaatttttctgcttttcctccaaaattaatccagcttttttcaaagtggataaatgatgagaaactgttgctcctgttaattgaaattgttctacaatttccccagcagacttcggccccgacttaagactatctagaatttgcctacgaataggagcagaaattgccttcaaggtttcagacaatcccataataagcctccttgtccatctatttagaaatatttctaaatagaattatactctgtttttattgtttgtcaagaactatttcgattattttctaaatagatttcaaaaaaaacagaccactctttatggtctgtcaaatccggcttatctctcccctttattgcgaatcacaaagcctgttttcttttcacttgatgtgcgttggtgtggttttttgttgtcttgacggcggttatcgcgcttgaacttgtcatcgcgacggttgcggtcgttacgatcaccacggcgtcctccgcgatcacggtcgcgacctccacgtccacctttacccttggcttgaccaggtgcaaacttgaatggtaatggtttttctcgcgcaatttctacctctggcagactttctggatcctgaacagtcaaggtcaatacataaagcgctaactcttcaggggtaaattcagccgctaactgaatagcatctttcttgaacttatcaaaattgttacggatggtttcatccgccatttcacgctcaatcttcttcaaagcaacttttttcttggcttcaaaggcctcttcagctgtcgctggcttgagccctttcatgcgtttcttggtcaaatcttcgataatagccaagtagcccatctcgtttggcgaaacaaaggtaatagactgacctgattgacccgcacgacctgtacgaccgatacggtgaacatagctttctggatcctgtggaatatcgtagttatagacatgcgttacaccagaaatatccaaaccacgcgccgcaacgtccgtcgcaacgaggacatcaatctggtcatttttaaagtcacgaataacacgaagacgcttattctgatccaaatctccgtggataccctctgcacggaagccacgcagtttcaaaccacgagtcaattcatcaacacggcgcttagtacgaccgaagacgatagacaattctggctggtcaacgtccatgaggcgtgtcatggtgtcgaatttttcatgttctttgacacgaagataatattggtcaacattgacattagtcaattcctttgctgcaatcttaacgtgctcaggctctttcatgaatttgacaccaatacgcttgattggctctggcatggttgcagaaaacagaagagtttgacggctttctggcacacgttcgatgatggcttcaatatcatccaagaagcccatgttgagcatttcatcagcctcatcaagaataagggtttcaacaccgtcaagcttgagagctttacgtttgatcaagtccaagagacgaccaggtgtaccaacaacaatgtgagcaccagaacgaagggccttgatttgtttttcaatgctagaaccaccgtaaacagagcgaacttttactcctttttcacgaccaaatttgaaaagctcttcctgactctgcaccgccaactcacgcgttggggcgataatcaaggattgaattgcttgattgtttgtatcaatcttgttgagggttggcaaaccaaaggctgcagttttccctgtccccgtctgcgcttgaccaatcacatcttttccttccagagcaagcggaatggtctgctcctggattggtgacggcgtttcaaaaccagccttctcaacggcaagcaaaatatcttctgataattgtaaatctgtaaatttcaatgtattctcttttctaaaaggcagtgcgaagctaccttatctaacttttttgtaacaagatatcagggtcgaaccactgatattggatttgcaacttaccaagtataacacaatctaacaataatagttaatatttacctttaaaaagtcaataatacgttttcatgaggagtccatcattttatagacatttgaattagctttgatacatcgatactttcggtttgccctactctagtaccagctccttgtctgaaagttatactcttcgaaaatcaaaatcagacgttgttgacttgatttgatgaacttcagttctatctgcatctgcgtcgcctagtctgtttttgattttcattgagtattaattcattcgactataagaaaagagaaacctagttatacatgcacaactaggtttctcttgtatttttatttatgattattctttttcaatgcttgcaagaaccagtccaaacttttactgataatgacaaccattaccaatgtccaaaatgtttttacaagcccaattttaaaagccaaaggagttaccacaaatacatcaaaaatgagaataacggtggaaatcttccatttgaaatatttattacacaacaatgcaataatatcacttcctgccgtggacccgtttccataaatgactagagccattgataaacctgtcaccaatcccgccaagagagcagagggaatcaggggcaaccattttatttgcagaaaagtcgtataatgcatggttaaggacatagtagcaaccgctaagaaagtatagaaaaccgttaacttactcaaaaagcgataggctaatacaatcaaaatcccattcaaaacaaaactggacagacttgtttcaatccctgtcgtataaaacaaaagtagggtaacaccagtaatcccaccttcgccaaattcatgtggaatgatgagcatattcaaaacaagggcatataggattgccccaaaacatatcaataagcagtctctccattttatctgcgtcatattctctcctcacaaacagtccaccttagtatatcaaaaaaagcagaaagcggatagccactttctgtacttttttcctattttcctaagacagctgaagccagagctttttgaatagcaatgacactcttatcgctcttaaactgaagaatttcagcaggttcaacagccgatgaaatccatattttcagctcagcatctaagtcaaaatgaccagaggtttctaccgtaaaacgtgaaatcgagcggtaaggaatcgatttataagatacctttttcccagtcattccttgcttatcgaccaaaatcaatcgatattctgtaaaaacaatcagatcacgaaccagactaaatgccatctcaacctgttcattatccagtagaacatgctccaattcctgttcaatcttatcattatccatttgcgaggcattgcctagtaaacctgaaaatagtcccataatatgactcctttggtatttttctatagtataacacaaaaagctactagttgactatcttaggcactaggtctttaccaaacatgagaattactcgcttacctttgcttccttatcaacttctttaggttgattgttctcaatactgccaccttcaactgctggaaaatgttctgcaatcgcagatgggatcttctgatcatttagatttaattcttccttcggaatgtgattttcactcacatcaattgttttcaaagtcttattcggctctgtaatggcaagtgtttcaatatcattttttgaagcattcaggtcttctaaggctttgtaatcattgactccttctaaattcttcaattgattatctgcaacatttaatcgaacaaccgattcttgtttaccctctatttccaaagtcttaatttgattcccctctacatccagatttactaatttttcattttcttctatcccttgtaattcagtaatcttattattcttaagagtaagactagttaaatttggattgttttttacaaactgaagatcttttacattactttcattagctgtcagttcttctaaattctctgtttttagagttgatatatccaattgaggattctgtgatatatacaaacgggttaacttcttcttgttttgaagcgcagataaatctgtgatacgattattatctaaactaacagctgtcaattgtgacaaatctgctaatggggataaatccgtcactttattatgatctaaatttaaagattccaaagcttttaatttagctagaatagtgatatcttcaatgtcatttcctgcagcagaaactacttttaagtttggaaattcttccaaaaagcccaaatcagaaacaccattttgtgataagtcaattccctctaatgttggaatttctttcaaaaattgataatccttaacgcctgtgctagtcatccataattgtttcaattttttaaattgcaagataggttttacatcatcaattggcgtaaaaccaatccctaacacttcaacatttggcatcaagtccagaccggctctctttagcggatcttttcgctgaccaatatttagatattttaccgtttttaaccactctctcatcttctcggaatctgtttcattagatgggaaaggagtatcggccgtagcatgcaaaatatcttcaataatctcatcatcaaaacctaattgttttaaagtagccattccaattttatcatgagcatgtgggtcaccgtgagggtcttcgattggttttccaacttcaactttctcaatcaagattgtatgagaatggtcaccatgagggtaaacgaaagcaggtcctgcatctgtttctatcaccttgatttttgcttttgaaacatgcaggttttcggctaggtagctctttttagcttctcgttcttcttctacacttgagttaggtttcccaccttcttgtggtgacaacggaatttctacattaacttgagtggaagttgacgaatggtattctgctctagcagtctctaaatactgagtaggaatataagactcccacggacttcctatcaaatgactgtacggaagtaaatgagtatgagtaccatggccaatgagtaaccctaacgctgtttgaccttggactccgctaccatcaaaaaggaaaccgtcgcttgttggataatcaatacctgggaaagctttctttgaattagactgagtggaagtatgccctttttctgtggtagacttgagtgggacgaaattatttcttgtggtcggagtatgcaacgaatgattatcaagaacagtaatctgtcccttttttccaatggtctccccagtatttccttgtccgtattgcaaacttgatttccaaatataatgataatgatctccatgacgtaccgtatagccattcgcatcttcagccactacatccttcggatcaaatacataaccatcatcaaaagtttgtgatagcttcgcttgctttgcgttggaatgcgagctggattggctattctcaatgtactctttgggtaccagataggaccatttgctttcttttaaatccttatagaagataaaatgtgaatgaccattatgttctaagaccagtccctcatccgtttttgaaagaatttgaccttcattttcaaaaagaaatccatcatccgtaggataatcaacaccagctaccccttttttagcttgagaagtaggtttcttttgatttttggtgagtttcttagcttcagaaatagaaattacattagcatctttatccttgggatagtagaagtactgctcatttacttttataatataacctttctctagctgatactgaatatcttctttattcaatttataatcagaatctggaagggtatcttttaaaaagtgtgccgcatacgggatcggaccttcaaaaaagtatgactcttctccatatagacgcatatagccattagatttaatttcagacactacaatcgtattttcatctacttttgagatattgctactttgaacatcttgatgatttattgcagtattctctgttttttggcaacccgccaaaaaaagatgacaagataggataatgcctgtcaaggcaaataaggttgttttctttttcatttttgtcctcctaagctcattaaccagttaacaattaactagtatacattttatttttgatttttgcaagaaaaaacaactgacaatgattgttcgtgaataaattttccattccacgacaaacgcatgaaaaatttgttttataaaccatattttcacgactgctgtcagtttttagtagaaaaaatgtaatataatagccttggaaatgggggtatccttgttaaagtgcaagttttacaaaaaccttaaaaaaatgcatacaacaagaaaatagttacatacctttttcttcatgcggattgcatgtttccatccctacgatcattgacaaagcaaacaaactatagtatattaaaaatagggaaataaaaggagaatatatggaaaatacatctactcaaactttcgaagaactcgttgcggaacagaaaaagaaacgtaatcgcgtccttagaattattatcacactctttaccactattatcgtattttttgcctgtcttgcattattcaaatacaacagtggcaacattagcggtacgtggcgtaattcccaagctgaacaagatattgtcgaaaccagtatcaaggaattgcaaaatcaacttccaggtattgataaaacgtggattgacgcaacttatacgatgacagtcgtagataagaaagctgtcttcaccgctacaacaagctttgatattcctaaaatcgcaaaattaaccttggatcaagcttacaaggtaatgttagaggaagcacaaaaagaagcaagttctctgggaatttccgtagaagaatacttaacaaccgctctcggagcagattatgaaaagcaattgaaatcatttctacctacacaagctgaggcggaaaaagaatttcataagtaccaagacgaatatgctaaagaactaggtgccacatacaatcaagaaactggtactatctctgctacctttttcgaaggagacgtcgatcagctcttccatactgtgaccattacaaaaattaatgacgcagcaatcaaacagctgactacatacgatatttccgtaaaagatattatttcctattctcgcaagggaaataccaccattattaacggaaatgaagaatttactttagaaaaataataaaaaaagctgggaaagtcatccctgatggttccgacctcacccacagaataatgaaaataaatatgaagccctcactaggtgtataatcttagtgagggctttgtgcttgatgagttaatgatgttagtcatcgccggaaaaactaacccactctattgacgagctctaaaaaatatgcaatagacatgagcataagaactagccaataaaaacacagatagattcaagctaattttgatgaaatacagccgaattgtctgtgcttttatttttgtctctactatagataggacaacattgtgacgatatttgaaagaacttgtactaatactcaatgaaaatcaaaagtagcctaggaaacgaagccgaagatagaactggagttcatcaaggcaagttgacaacggataattttgattttcgtagagtataacctcctgtttgtttcatcacttacagtgtagtccttctgaccttttttgcatattgaatttaactaatgtcaccaatataaattattttctcttatataaccttttacatacctgataaagaataggtacagcaatgatggtcgtaattgcagtgccataggttcctaaaatcctacctaaagcagctaaaaataatactgatggcgttagtccaccgactaaactacccgtcaatgtgtacttcaacaggttcaagataatttttgtgagggctgcaactatcccaaccaacataatatttgatagactatcgtttgcctgtaggaatttctcataaaataagtgtaggacaaaacagacaatgagtgattctagaatggtaatccaagcaacggaggcatatcccgacagtaaatcaaagattcctagaccgagtgaggctgccagcgccccttttttggcaccaaagattagtactcctactaccaccagagcattgcctagatggacaaattgactcccaaaaggaatacgaataaagaagacaaccacacaaataagggctgcaaataggctaatttctgttaattgacgcaattgattctgtttcataatttctcctttaatatttgaaatgcctgctgtaattctgctagaaaaggttcaaaggaaatcccaaatttcaagtctctatccaaagcaagggtacgctctaaactcttatcgataaaatctaaagctagagggatagcttgatggagattgatttgttggatggttgctacagccaacaaggtagatagaatgtcacctgttccaaagaaatttgctggatattttttagacatataggtagttatttcccctgtttcctgctgaaaataggctacacctatttggctatcatcaaaggaaatccctgtcagtacaatatctgcggatacctgctctgctaaagcttccagtaagtcctcaatatcatgaatatcgtaggaatctcccaaatagtttctcccagtcaatagagaagcttctgttatattcggaagaatgagctgggccgactgagtcaattctttcatggcctctacataggatgatgtaaaacctgtatacagtcttccactgtcacccataatcggatctacaatcaatggtgtctctgtttgtttagcatacatagccaattgacttagttgctgaggatttctacagtagccagacaagatgcctgccaactccaaattcaagttcttccactgttcaaaataggcttgattcaagtcagtcatatcttcaatgacaacatctgggaaaccgcctgtgtgtgaggataaaagaactgtaggtaaaagcattgtttctacctgacaagctgctgcaattgggatgctagttgctagtgcaaccttaccaacaccaggtaagtcgttcgcaagcaataatcgctgcatgataactacctcctaaattatttttcataaacaaaattgtaaaggattatcatacatttttcaatcttacatatccgcaactgtatggggacagatagctgaaaccttgcaacaccaggctcaaattattacataagaaaaacagcaacaactctttgctactgtcatcctcttcaatgtattgttgtcaaattctgtttaatatttctccagaaaggcaatcagggtctgggcagaacgttctcctgcttgaatgataaattcatcaaaggtgatattggcatctccctgagctgtgtcactcatggcacggataaccaagaatggcttacctgtattgacagctgcttgagcgatagctgctccttccatctctacggcaaggacttctgggaaatgagttttgattgtagcgattctctcctgacctgcgataaaactgtcacctgtcacaatcagacccacatggctaatcatttcctgctctgctaaaacggttcttagctgttctaacaagacttggtcggctggataatacaattcctgccctgccatttgcccgtaagcatagccgaaagccgtcacatccacatcgtggtaagccaattgattcgctacaaccacatcaccgatggcaataccttcagcaacagctcctgccgaacctgtattgacaatgacatcaaccgaaaatcgatctgccaaaacagccacggacatagctgacataaccttaccgatacctgactgaacaagaacgacttcatgttgaccgattcgtccctgatagtaagttcgacccaagacatcgatttcagttgcatcttgtagatgctcgaccaaaatctttaattcctgaggcatggctgcgataattccaaatttcatctcttctcctaaataaataatactgcaatgataaacattatcagtaagatgatgacccaaaaaaggattttgtttaccttactgcggaaagcttctcgcttgatggtttcgatacggcgactttttactacagtaggtttgaccgggattcggatcgtttgtccctcttcatatccctgataatcttcttctagatatggatcgaatagagcatcatccattgatatatcctggtttggacgatagtgtccaaactggctagattggtcggaatactgtttctttttcactttctctaaaatttcatccgtcaacaagggcttgcccattgctagtttcctactttctcatgagttgtaaatattggatagccatgatggtctttgcatcacaaatatcgccagtagccaccaagttcaaagcctcttccaaggttacctcatgtaattcgataacctcatcttcatccattggacgaggattttcaaccttgataaggttatctgctaaataaaggcgaattcgttcattacagaaaccgatggctgaatagaaatctgccaacaaggtcaatttgtcactagtatagcctgtttcttcttctaattcacgcaaagcagcatcttcaagcgtatcttcttcgcccagctccaatttccccgccggaatttcataaatagtacgttcaatggccttgcggtattgtttgaccaaaatcattttaccttctggggtaacggctaaaacgcaaactgctcccttgtggaaaatgagttcgcgcttaccagttccaccatttggcaaggcaacatcatctactactacatcaaaaatgtgccctttaaaaatttctgtccgctcaatggttttttcttcaaaattcatatgattacctatttttgacttggatggaacggaaaacgagtcgcataaccttctttgttttcttgacgaccacgaccaataccgatggcatcctctggaatgtcttttgtaatgacagaacctgcagccaacaaggcgttgtccccaatagttactggtgcgatgatggttgaattagagccaacaaaggcattatctccaacggttgttttaaatttatttttaccgtcgtagttgacagtaatggtaccagcaccaacgttaacattattgccaatcgttgcatttcctaggtaggtcaaatgaccagacttcgttccttgaccaagtgtagaggccttgatttccacaaagtttccaacgtgaacatcttttttcaagagactacctggacgaatatgggcgtatggtcctaccgtcacaccttcttcaataacagattcttcaatgtctgagttgctgatgactgcatctgctgcaattttggcatcacgtacacgagtaccattggttaaaacagtacgttcaccaatcaccgtttgccctttcaagacaacattagcttcgataacagcttctgcaccaatctcaacatcaatatcaatataggttgcatctgggttgataaatgtcacaccattgaccatgtgtttttcattgattcgtttgcgcataacagcttctgcagtcgcaagagcgacgcgatcattgacacccaaactttcatcaaaatcacgcaatacataggcaccaaccttctcgcctgcctgacggaaaatcgaaataacatctgtcagatagtactcaccttgggcattgtccgtattaatatctttaagcgcttcaaaaagacgtttattatcaaacaagtaggttcctgtattgatttctttcacttgtttttcaaaatcgttggcatctttttgctcaacaattttttgcacttcaccatcagcattgcgaataatccgaccatatccgaatgggttatcagcctgagctgtcaagatagtcgcaacattcttgtggctgacatggaagttaataaggttcttcaagctttctcctgtaatcagcggtgtatcccctgcgataacaagggtctgaccttccaaacctgcaagagctggctcagccatcataacggcgtggcctgtccccaactgttcagattgaagggcaaactctgactgaccttcgagaactgcttggaccaattctgccttgtgaccgacaatcgttactgttttagcaggttccatagcatctacagcccgtttgacatgctccaacatggtaattcctgccactttgtgtaagacctttggcaagtcagacttcatgcgagttcccttacccgccgctaggataattgcatagttattgctcatagttttctctcttttcaatgatataccctattatagcaaattttgatgtttttggaaaatagcaatattatagggaattttcgtaaataaaaaagaaactggaatgaagccagtttctcaaaaatttctagtattagaaaacaaactacaggttgattgcatcctatagaattgtctatttaggataaaccaattcaaattcttcacagacgaccagcatatcttctgagaaggacaggcctgcttctgccagccagatagtgaaaagctcttcatggatctgtcgccagtggatcagacttttcgcttttatgtcagacaagtcacctccctgacggaactcgccctccttgtaggcatgctctgctgtcacttgggaaaagggcgtcacatagaccttggtggtctggataatgcaaacagcctgaccttgtccgtccagaatgatgtcatagccaccagctcttgggatttcttctccctctacttcatagagagcatgggcagagctggttgaagttttgatgcctctagccaccaaatcagccagtcgatcagcttccgccccaaaggcccaagcctccggctcaggacctgcttgggaattgatggcaatgaattcttgccagagttgtgtcggggtcatagggggtcctttctagaaatttgccaattcttcgcttgatcaagtaaagcctcaaatccataagggatttgatttagaagtgtttcggttatcccaaactgaagtatctcaactaaagcaattaattgaacatctgcaatgtcatgaatatctccacaaagaaattgccacatcccatcttccaagtcatgactgatgtaggttatcggtttattctcttcactatgtgtttacagatcactactgctacatgaggattatcatcaaaaatcaacatcactttcctccctacttcaaactccagccaccgtcaatggtgataatctggccttgcatggaagcgagttttccagtagccagcatgaaggtcagctctgcgatttcgcttggttgggtccagcgtccgataggggtctggtctgccacccagtccgccagaccaccaggctcaaagtccttctgggtcatgcctgtctggacggcaccaggagcgatgccgaagatctggaccttgtccttggcatagtccagtgccaactgcttggtaaaacctgccaaagcgtgcttggaagcggtataggcagagccacctccacctgctagactggaggcaatggagcacatattgataatgatgccagactgtctgtccaccatttgctgcagataggggcgagttagtctagtcaccgcaaaaaaattcaccgcgaagatctgagctaattcgtcctccgaaatatcgaggtggggtcggtaatcgtctaaaatgcctgcggtgttacagaggacatcgactgactggcaccaggaaaagacgggcgataaatcgcctgtcaggtccagctgtagaaagtggaaatcgcctgccaaatcaggcttgctagccagatcaatcccgaagacacgccagccattttccaaaaaaatccctgcctgtgctagaccaatgccgctggaaacgccggtgatgagggctgtcttagtcatggacttctacccagtcggtcgcaaggacatcgcaaggggtcgggctccacatggagaagccttcaccctcgccggtcacgttgatgaggaaatagggcgtcgcctctagcttctgcccgtggacctcgatggtgtcaaagagctggacgtagttctccgccccaccccagcctgtgcgaacgtactttttcttggccttcaagcctggtaaaatctcttcaaatgtcatgattattccttttcttatttattttaacacaaatgttttcagtaacgaataagagttagctaagtactctcttttgttgattgataaatctgtagatagaataaaatcatggcagcacatagaagaccaatcggtagccaaactgtccataaatcaccactaaccagattcatcaccaataattttttgataatgcctatcagtaaaaaagcaaaaatcggtaaagcaaaggttctgaatactttcaccttaacagagaaaactatcgtggccaaacttgtcacaatcacaaataaccaatcgaacatttctggaaatttcaaatagattgccttatctccaatcattgctggtaaattgaaaataatgttaaaaagaataattattgttaggacaatcaagcctataatcattttagaagcctttggcttaaaaagaacagatggtaacagaccgaaaaccagccaacaaagcaacaaagcattggtgcaagaagccaaaaacaggatgaattctaattgaaattgtcccgtgtttgcaaacaaaaggaaggtgccaatggcgtacaaggttgcgaccgcactgaaataggttatcgtcatttccctcaagggagccttcggtgcattttttaaaagttgatctgccatatctttggggtctgttccaaaaaaatctactgctgttagaccatcaacctcagccattttgaaatcactgaccatactataaatctgttccaaaatcgctttttcatctttaaaaaaggatttcaaaatcatatagtcgcgtatctcatcaaaataagctttattttcaggtaacaaattatctacaattatatttgtcttatctcgcaagacttgtttatcgcgtttcattaaatattcctttctgaatggttcctactttttctacaagacttgaccattcccgccaaaaatcccttaaataactctctccatcttgggtaatcgtaaaatatttacgatctggcccgtccgatgatggttttatctcgccaatgatataaccattcttttctaatttttgcaagagaggataggcagttcccccgaccatgttttcaaagccctgttttctcaattcctgaaccagctcataaccataaatctccttctgactgataatttgtaagacacagccgtctaggaccccctttagcatttgggtttctttcataagccctcctcatcatctgtaaaaaatccaaacagtaaacctgatcctaacaggatgcctaagatcaaaatagaatccaaggcccagcctgttataatggccgtcacaagcgtgattcctgctagtttccaattttcccgacttttcttctccagtttcatactgcctccctacctagtttgtaataccgactagtttgataaaaataaaagtgattttctttgtcttctatcactagtttgttttacctattagctttgtatctatagtctaacacaaggtggctagtttgtaaaacaaaatagtgaaaaatattcaaaaaaaatcatgaccacccgtcaaacgggtggtttgaacaagggctataagcccacatcaccagccagcgcctaaagacgctggctttcactttgttcaagcctcactgcttttgactcgtcactagcctcttaaagaggcattcgtactacttgccattatccctaaagggatcttcatactcttttacactcaacttatcaagtgctatatcatgtttttcctgttcttgtatatatttcttaattgtggcttcatttagtccaaccgtacttacataatatccctctgcccagaaatgacgattaccaaatttgtatttgagattggcgtgtttatcaaacatcattagagcactcttaccttttaaatatcctataaagcttgatacacttaatcgcggaggaatactgactaacatatgaacatgatccggcatcagatgtccttcgataatttctacgcctttataagtacacaaacgtcggaatatttctcccaaactacttcgatattgattatagatgatttttcgtctatacttaggtgtgaagacaatgtggtatttacacagccactttgtatgtgataaactatgtgccttttgcgccatatttttctcctttcgctttacaataggcttgaacacctttattgtatcgcgtttggagtttttttggtgtaaccttcgtcgcgcacccgcatagcgggtggtttatttgtcacgcaccttacggagcgtgacggactaaaagtcacataattaaaaacttgggttcccccaagtttaggaaataatctgtttgtaagatcgtgttgtgatggcatagaccactaggtagaggaggagatagccaccacagatgcctgcagtcacctgcaacataagccctgcattgaccacaccgatagacaaaagaatggacgagagcatcttgtaggcaaatgcaagatggacaaaggcaagtaggataggtaggaaaaagacggtcagcaattgcttgcgaatggactgtctggtctgatcctcatccagaccaaccttggtcataatgacaaagcgatctctgtcttcatagccttccgaaatctgtttgaagtaaatcaccagcaccaccgccatcaaaaaaatgagtgaaagtaagaggccgatgaagaaaagtgaacctgcaaaactgaagaaactacgcatcgcataggcacggtaggcgagactgatggcgttcgttccattcggtaatatattggactcccaaagctcactttcaaaactaccggataagaagacctcctggctatttacctgttcttcttctgatagactgctttcaaagcccatataatagcgattttcggcttgattttcaaatattgtcaagtcttgaacaacaataactaaatacttactaaaattaaaagtcacatggtctggcagatgtcccaaggtcacattcttgggcaagacttgggcaacttccatctccttttcatcaaaggtgagggtttgaccagcttgatactggactcccttactataaatggccacttggtcagctgccaactccagtttttgactagtcattttttcatatgtagctttatccaaaatatagcctacacctacttgattagaaaaatccatccatgactctttttccgtcaaaaatcttacttgctgatttgccacctcagaaaaataggcttgctgataaggatagactaccttactttcaacaggaatatctgtctcttctaagatagcttccgcccactcctcccacttctccgtttgagcttttgaagtggttggctgcataccaacatcaatcgaatagtcatttggattttgattggcaatataatctttgccaccgatgtaaatattgagtcctccaaccatggtcaccaagaacatgctggagaggatagtaatggtcgcaagacccagtgcatttttccgcatacggaaaatcaagttggatacagaaatgaaattatctggcttataataataggtctgacggttctttagccagtttaagagactgatgacacctgcgtggaagagcaggtaggtcccaaagataaccagaagagtcgctccaaagaaacttggaatagcctgcatcggactggtcaccagctgggcaatggcgtagcctgcccccaataagataagaactaagagggtttgtagccagaggaagcccgttttcttgtcccctcgcttcttaccttgaaccagtttgagtgagtcggtcaagcccagatttccaatattaaaaaggctgaccaaggcaaaaatcccaaagagatagataaatacagtgactagacttttcaactggaaggttgaagccaggaccacaggcatctgcatggctttcagcaagagcgcatagaagagtttatctagagccagtcccaagagcaagccagctagaatagtaccgactgaaaagaccagattttctagaaaagtcatcaagaagagatgttttttctccagaccaagaatgctatagacaccaaactcttttgaccgctgcttcataacaaaactattggcatagaagaccatgatggcaacggccagcataactacaatcataccgaagcccagcacttgaatcactccattggcccccttgacctgacctaaatcaggatgaaaggcaagtgaggcaaaaatataggcaatggctgtggacaaaatggtcatcagggcatagggaaaatagagtctgcggttctttttgagattggtcagagccaatcgaacggttagtccaaacatactactcacctcgattcgccataagtgtcaaggtatctgaaatcaactgatacatttcctgactagttctctcacctcggtagatttgattgtagaggatgccatccttgatgaagagaacccgtttggcacgactagctgctactgtcgagtgggttaccatcagaatcgtttgcccctcttggttgattttttcaaaaatatctagaagagttgccgttgatttagagtcgagggccccagtcggctcatccgctaagagaatttctggctgggtgatgatggcacgcgccaccgcaactcgctgctgctgaccacccgaaatctcgtagggcatcttgtcttgcaaggtcgcaattcccaggctattgagcgtatgaacgagtcgcttgttcatctcatcaatcggatagcgagacaaaaccagaggcaagagcacattatccttgacagaaagagtatccaagagattgaaatcttggaagacaaagcccaatttctcccgacgaaaggctgccgcttccttgctcttgatagattgggtatccaatccgttaagcaagaccttgccctgcgttggcttatcaagggttgccaaaatattgagcaaggtggacttaccagaacctgactcacccataatagcgacatattcacccttttccactgcaaaatgaatatccttcaaagcttcaacctgtcccgccttaaagagagaactgtatatcttttgaacgtgttgaacatctaaaactgacataacttgactccttttctttttctaccctcattctacacggtcccaagacaaactaccatagtcctagctttcatttgcgtgacagttttgtaagattagtaaaaaatcaactccacttctttgataccgattcgcacctctgttccctgacctacttttgattttagctttagggaatagcccagctccgcagcaattttccgtgagagatagagccccagacccgaagattgctgggttctgcggccattgaaacctgagaagccacgctcaaagacccgttccaagtcactctctgcaatcccaattcccgtatcgcgaataaccaaatcatctccgtccaaaacaatcgaaatggtcccttcctgacaatacttgagggcattggataaaatttgctctatcaacaggcccagccagcgtttgtcggtctttactgtcctatccaactgccccaagtccaagctagtattgacctgaatgaaaaagagggaatactttcttactagatttctgaccagttcatccaaattaactgattcgataaccaaatcatcatgaaaggactgtaagcggagatagttcaagaccagacctgtgtattgctcaatcttgaagagttctgtttctagctgatgacggactggactactatctacttccttaaccaagagctgactggctgcaatcggcgttttcatctggtgggcccagagggtgtagtagtcatctaattctgtctgttcctgtcgctgtttttctaggatttgcttgttctggacttctagtcgctccactttttcctgcaacaaacgctcactggctgtcccagtagtcactttctgaccacgccagatttttccaaagcgggaaaattccctgacaaaatcccagaggagggcgaggagccaacaaatactgaggaggaggatggcatagaaaaccaagtttcttttgatgtcaaagaggctactataagccagaatagccacagcaaaaacggcgtaggctatcagaaaaatcaagcgatgaccaagccatgatgtcaaaaatactggtactaatgagccaaaatcatccttattcatgtgtccacaccaggccgtagcctactcctttcttggtcgcaatcacatctggcagatccagttctgccaatttcttacgcaggcgagcgatgttaaccgacagggtattgtcatccacaaaaatatcactgttccagagttctctcatcagctcctcacggctgaccacttccttgccatgttcaaataaaacgcgtaaaatctgaaattcatttcgcgtcagctcttccacaacctgtccataggacacctgcatggtctttaggtctagggaaatctcctcaaaccagagtaaactttgttctccgacaaagtcataggttcttctaagaagcccctgtattttggccaggagaaccgtcatttcaaagggcttggtcacatagtcatccgcccccatattgatcgccataacaatatccattggctggtcatgggaagacagaaacataatgggcacacgggatgtcttgcgaatttcctgacaccagtaatagccattgaaaaacggcagaccaatatccagtaaaatcaaatggggctgaaactcttccatctgttccaaaaccatctgaaaatccttgacctcttgcacctggtaaccccagtttatcaagtttttagcaactagttggctaatcgttttatcatcctcgataagaagaattttctgcataactatctcctttcatatccctactatttattatagcttacattggaacaaatttgagtatttttatacatttacacaagaagtagactataaaaccaggtcatcagtggtgcagatttgtcagaccaatcatatttcgttatactagataaaaaaggaaaggactgctatgccgaatttattaacttatcttgaagaaactcaatacgataatttttatgataaacctatcaataagctagatattctggctctgaccgaactttcctacctcccttttgataatctggtcccctactcttttacagaaaatggtgtacgacttgatcggttggcagcggcctttgaagagacctacaaaaataatttccctcccttttctatggtgaccaaaaaccgcctagccttactaggacttctattcaaatccaaacgcttcaaatctatcaaggcatttggcttcgttgacgattatcagttggaacaggaaaagcagttttcagcaatcagctatcgcattgaccgaaaaacgattgtgacttgcttcagagggacagatgatactattattggttggaaggaagatttccacatgacctatatggatgaaattcctgcccaacgtgcagcgagtggctacttagaaaaacttatgatgcagcaggggggccatttttatctggccggtcattcgaaaggtggaaatttagccctctatgcagcatgccagcaagctacagaccaacaggatagaattctagctatctatccctttgattcacctggcttacacaaaaaacacttggaagcacctagttaccaagctattcaccaacggattttccctgtcattccccagaattcaatcgtcggtatgatgttagaaacaccagaaaatgctcagattgtccagagtaataccctcggcattctacaacacatcagtttttcttgggaggttgacggaagcgacttcaaaatagcccctgccctgaccagcgatagcctacaaacagaccaagccttaaaaacttggacggatagtttaacagacgatgaattacgagacttcttcgatttgtttttcggcatcttcatcaaagcaggaattgaacgatttagcgacatcacggtaaatcccctacagaaattacaggaaattgatcgactgagaaaagaaatagctccagaagaagccgaaatggtagacaaactcattcggctcctctttgacacccgctaccaaatttggagggacaatattagcacttccattccaagccctgaaatctctctaccagattggcggaaacttttccaaagaaatacaactgaaaataaagaaaactagctcaaccacttgagctagttttctttatcaaatcttcttaaaaattgagataatttttctaatcctttgattagagtttcttgttcacaggcaaaacctagacggacatagccgtcacgatcaaaacgattgccaggaactagaagaacaccgtattcctgcagaagttgcaagcaaaaatcttccataggcatatccactgcaatcttgacaaagctagtggaaacaaccgctggacggatataggaaacgaggggttcttcctcaatccattggtccaaaattgctaaattttcttctaaaatgcgccgatttcgttctagaatttcttgataatgggccaaagctaattgagccaccagatcgtcaaagacacctgcacaaatcatagtgtaatcccgataatctctcagaatgtccgtcacttgatgattggcggccacccaacccacgcgaatacctggcagagaataggtcttggataagctatttacagcaattcctttatcatagacttctataatagatggcacatccagctcagaaaaggaacgatagacttcatctgataggatgtaagccccaacttcactagcaatttccgccaattcttccaaataagccctatccatgacagcgccggttggattattggcattgttgatgcaaatcatcttagtgttaggacgaatgagctgacgcagtttttccaagtctggcaaccatccatgctcttcctcaatctgccacaaatccacttctgctcccaaagactttggaatatcgtagagttgttggtaggtcggataaagggaaatgacatggtctcctggctcaatcaaaccataaagaactaacaagtttgcccctgttgccccgttggtctggagaatttgttctggcttgacgcctgtatagagttgactaaccgattttttaaatgctggcgaaccttctatccagccatagttgagcttggtgccctgtaatttcttataaaaatcctcaggattggtgcccgacaaggcaaatagttcctccaaagtcaatgaagaaatagacactcctgcaatatcataaatcgcgctgttttcatggacattcagccattcctcaacgccaaaacgtggtaatttcataagacttcctacttttatttattctacccttattgtaccatattctttcaataattgtataaatatgcaacataacaagtaaagaatattactattattaaaaaacagactttctcaaacgagactgcctgctctgcttttttcccttaaaacttccctaaattcgtcaagtcttttttgtctggcatgacttccttgttgtcccagtgctcgacaatctttccgtctttgaggcggtagatgtcaaagtgagcgtagtcctgacctgcaatccagactttcgaataagccaccacatagtcaccctgtcccatcaccttaaagacaaagtcgtagttgacttgactctctaccagatagtccttataggctacaccgccttgggcgatttcttggttgtgctgaataagatcagctgccacatagtcgtcaaatttctcgattttcccattttgaaggacatcgaccaagaaacgacggacgattttcttgttgtcctcagtcttatctaggtcagtcagctcaaagtctgcgtaaatcgggtctgtttggccaatggtttttggataggcatcgataacatcccaatgctcaacgatacaaccattttcatccgaacggaaaatgtctgccgtcacccactcagccgcaccgtcattgagtttctggtggacatggacaaagacaaaattcccgtcctcaatggcacggacgatattgatttcccgcttgggattgcgtttgaaaaagtcctcaaagaaagccgcaaagccctctttctcatcaggcacacccgtactgtgctgggtatagctggctcccatatagttttcatgaacttccttgatttcgccatcgcgaatgccacgaaggtaaagatttttagcattttctagttgatttgacatgattttctcttattttaacaatccttcttgttctaaatattccctcgccacttgctctgccgacttgccttccacatcgaccgcatagttcatctgggtcatttcctcggtcgagatgttgcctgccaagacccctaggacttgctccaactcaggatattgttctaaggtttctttggacaatagcggagcggcctggtaaggtgggaagagctgtttgtcgtcttccaggattttgagcttgtaggtgaccaccttgctgtctgtagaatatgcttcgataatctgcacattaccactcttaatagcttcataacgaagggctggctccatggtcttgacattgagttggagattgtagagattttttagaccgatattaccatcttcgcggtcgttaaactctaaagagaagccagcgacagctgtctgctgcacttttgccaaatccgaaatcttctcaagaccgtttttctgagcataatcttccgttacagccaaagcataggtattctggaaagccattggtgctaaatacatcagaccatcctgttccaaaatcgcttctttagcgtaggtataaacctcctcaggattcgttgataaatccattggtgaatttttcaaaagagtacttgtaatggtccctgtgtactcaggataaatatcaatagaacctgatttgagtgcctcataaaggaagctagtctttccgaaattaggttttatctccaccttgatgtctgtctggtcctcaatcagcaacttatacatattgatgagaatttcaggttctgcaccgagcttccctgcaatgaccaactgttttgtggaaaaattaagcatgggaacataactagctccaacagtaaataaagtcaccaatagagccaataaaattgtcttgggtttcttgtcctgcaacagacgaatgccataaccaaaaagcactgcaaggacagccgacgataccgcaccaatcaaaatcagggctgaatcattgcggtcaattccaagtagaataaaggagcccaggcccccagcccccaccaaggccgccagagtcgccgttccgataatcataatggaagccgtccgaatccctgacatcaaaataggcatggcaagagctaacttaaattttttcaacttctcccatttattcataccaaaagcggttgctgcttcttccagagaagggtcgatttctccaagtcctgtcaatgtcccctgcaagataggaaagatagcataaataacaagtgctactactgctggcaaggttccgattcccataaaaggaatgaaaagaccaagcaaagcaagggatggaatagtttggaagatacctgttatttgcagactccactcggtcaagcgttttttactagatagaatcagtcccaaaggtactgcaattgcaatcgcaataatcaaagctagaagggagatgcgaaggtgttcaaaaagagcaattccccactcgtccttgcgttctataaaggtttcaaataggttcattacatacctcctcgagctctgataaattccttgacaaaatcattggcaggacgattcctcaattcatcaggacttcctaattgcacaacttgtccatcttgcatgagacagatgcgatccgccaatttaaccgcctcatccatatcatgggtaacgaaaactgttgtcatcttgaattcctcatgtaattccttaatcaagtcctgcaactgagccttactgattggatccagagctgagaaaggttcgtccatgagtaacactttcggatttgcaatgatggcccgcaaaatcccgatccgctgtttttctcctccagacaagtccttgggcaaacgatccagatagctgtctggttccaagccaaccttggtcaatagctctctcatcctcgtcagggtttcttccttgcccaaacctttcatttcaggaataagagcaatgttttcagctaccgtcatatttggaaaaagggctatctgctgaagaacataacctgtctccaaacgtaattcacgcaggtcgaaatccttaagtcgcttaccttgaaaaaaaacctctccctcggtctgctcaattagacggttaatcaatttcaacgtagttgtctttccgctaccactcggtccaatcaagacaaagaactccccttcttgaatatcaaaggtcaaatttttcaagattggtccactaaccttacaggtcagagatacattttgataatcaatcatcatcttctccttttaaaatagccatgagactctgactgtagcgctgaattaatcctagcataagctcctgttcctcctgactgagttgagacagcgccttattttccgcctcctctaagggatccaaaatgcgactagcaaattgttgcccctcctctgtcaatttaattttcttatgtcgcttatctgctggattctcctctaaaactaccaggcctccatccaaaaatttctttacagtagcattgacaacttgtttgcttgaataggtcttcttactgacccagttttgcgtcacacctccgggattataataaatccacatgagaatggataaacattttgcattgagtccatgtccacgagcatagtcttcataaagaccgacttgctggtcaaacatacgagcataatccttactccttttctcaacttccatcatccttccccctcctcagtgagcacaactaccttactaaaagcctctggtctactagtgttcaaaacaacaacaattttcacaacgacttcctcctgtaatcatgttagtcaatattttttactattttaccaaaaaaagaaaaatagtcaatcattttgactattttgagacatcaactaccttattatagattcccgtcttcatccattcaaacatattaaatccctgaaattatctgcttttaatttacacaaaacaaatgataatcagataacaaaactagcctagaaaattctaagctagtttcattttatccttcaactgcttctgaggtagtttcgcttgctacttctgaaacagtttctgataccacttcagtttgaacatcttcgatatcaatttcaatatcttcagacacaactacagcatcctcaatatcttcttctgtcaaatccactgtcggagctttagcagtttttgccttgatagcttccaaaatgtcagccgttgataagttttgttccgcaattttttccttgatttgctcaaaggtttccaaggatttttccttaccagacttgaccaaatcttctactgtcaattcaccagtttcaagttgagtttttacttcagtaaatcgttcagtcgcttgtttgcctaaatcttgtgccttagtgacaaaatcagcattgatttcttcatggttttctttatagtcattagcaaagtttacaactttttctttgactgttttaccagttttacttgctagaaaagcagctgcagcagctccgccggctgcccctaacaaaaggctagtccacacgctactagatttttttaccatttttttctcctttcttacctaagagagatgagagagttgacagagctgaaagagctccgccggcttttacagtacttgctccagcagacttggctttgactgtcaaatcacgcgctgaagcattcaaatctgatacagaagttgacaagtcagctaccgctacaaaaagaggatcaagggtcgaaaccttgccatttacatcttcgactaaaacattggttttagccaaaagctcgttggtctgatagagagtcacattgacatcgctggtcaagaccttaagcgtttgctgggcttcatccgttaccgtacccaattttttcaacaacaaaacaatatatactgccaccgccgcgatggacaaggcaataatcaagacagaaatttcaataatcatatcttctcctttagggttgatagaatggaatagaagactttcttctccgcaacacaaccatgataataccaacgaggattaacaccccagatagccattgtgaaacacgtattcccaagaacatgaggctgtccgtccgcaagccttctatcaaaaggcgaccacaaccataccagactaggtagaaagctgtaatttctccctgtttaaggaattttggccgtctacgtaacacacaaaccaagccaaagcctagcaaattccagagagactcaaacaagaaggttggttgacggtaggcaccatcaatatacatctggtctcggataaaggctggcaggtagttcaaactttctactgccttaccataggcctcttggttaaagaaatttccccaacgacctattgcctgagcaatcatgaccgatggcgctacaatatccaaaaaatccagggtattaataaagcgatactgggtaaagaaataaaggacgattgcacctgtaatcaaaccaccatagatggcaataccaccgttccagatagcgaagatagataaaatgttatccttatattcactccatgaaaaggcgacgtagtaaatccgtgcccctaggatagaaagcggaaatgcgattagaataaaatctaaaatatcatcctgacgaattttctttcgcggaccctcttttgtcgccagataaacacctagaatcagaccaagcaaaatgcagattgcataccaacgaatttctaagggacctaatttaatcgcaataggatccatattaagcctcttctctattgtgttcaattagattagacaagcgttcttcgaagatcttcgttgcatcaaaccccatctgtttggcacggtagttcatggctgctgcttcaattacgacagaaatatttcgaccggtttttacaggaatacgtatttgtggaatagcaattcctgctatttcgatagtatcgccagagtttcccaaacggtcaaataccttacctgtttcaaaattttcaagatagacagctaattgcacttctgatgaatctttcacggcactagcaccgtatagactcatgatgtcgataatgccgacccctcgaatttctaataagtggcgcagaatttccgcaggttcaccccagagagtaacatcatcttttgcatagacatcaacacggtcatcagccaccaatcggtgtcctcgtttaaccaactcaagaccagtctcactcttaccgataccagaatcaccctggataagcacacccataccgtaaatgtccatcaagataccgtgtacactcgtccgctgagccaggcgactatccaagtaagaagacaattctcccgatagacgactggttgctgtcttgcttcggcagatagcaatttgtttttcttttgcagccttgtacatctcctcagggatttccaagccacgtgccactatgacaacaggggtttctggctggaacatctgagaaagaacctgatagcggttatgggcagtcatggccatcaaataagaccactccttcatcccaatcaactggatgcgctctggagcataataatcaaaatagccagtcatttccaatcctggtcgggtaatatctgccgtcgtaatttgcttttgcaggagctcttccgtactgtaaacacattcaatccgcagattatcgaccaaatctttcacataaacggtcatttcttccctcactttcagttttattatattataccataagctaggggttgggggaaaaacaagtggctgatttggcaaaaagaatgagttctttctttttctcacaaaattagcaaaacttccacagattaaatgtacttctcttccttcgctacatatttttaacaaatctgttatactttatatagatcaatacttactactaaggagaaaatcatggaacccttgtttctcacacctgttatgcacgaaaaaatttgggggggcaatcgcttaaggaccaactaccactacgacattcctagtgataagactggggaatgttgggcaatctctgcccatccaaatggcgtaactactgtctcaaacggtcaatataaaggaagaggactggatgacctctataagaatgaaaaacatttatttggcaatccaacagatgatgtctttccattattaacaaaaatccttgatgcagacgattggcttagcgtccaagttcatcccgatgatagctatggcttggctcacgaaggggaactgggcaagacagaatgttggtacattttggaagccgaggaaggcgctgaaatcatttatggtcacaatgcccaatccaaagaagaactccgtcagcaaatcgaagccggagattgggacaagctgttgacccatgtacccgtcaaaaagggtgatttcttctttgtaccaagcggcaccatgcacgccatcggtaagggaatcctgattttagaaacccaacaatctagtgatacaacctaccgtgtctatgactttgaccgccgtgacgatgcaggcaacctccgtgaactacacattgagaaatcgattgacgtgctgaccatcggacctgttgctaactcaacacctgcccacctcaaagcaggcaatcttgactcgacacttctggttgccaatcccttctttaccgtatataaatggaatatccaacaagaaatcaaaatgaaacagacagttccttacctgcttgtcagtgtcattgaaggggaaggtgccatccaagtcggtgaaaccagctacccacttcaaaaaggaagccactttatcttaccagccaatgtgacagactggacatttacaggccaaatggacatcatcgccagtcacgcgaactaagcatacaaaaaacttgagcctttaaactcaagtttttttgcattattcaaaccaagacttatttatcttttccgcttcttttatcttacgtggacctgttccatagcgttccgcgtccctatcttccttataaggtaaaaaataagctgctgcaatatagagagcaattagaaggaggaaggatttgcctaagaggagacctgcaatatagttaaatgaaacaaaaacagtacatttatgatataatgtatttatggcatattcattagattttcgtaaaaaagttctcgcatactgtgagaaaaccggcagtattactgaagcatcagctattttccaagtttcacgtaacactatctatcaatggctaaaattaaaagagaaaaccggcgagcttcatcaccaagttaaaggaaccaagccaagaaaagtggatagagataaattaaagaattatcttgaaactcatccagatgcttatttgactgaaatagcttctgaatttgactgtcatccaacagctattcattaccccctcaaagctatgggatatactcgaaaaaaaagagctgtacctactatgaacaagaccctgaaaaagtagaactgttccttaaagaattgaataacttaagccacttgactcctgtttatattgacgagacagggtttgagacatattttcatcgaaaatatggtcgctctttgaaaggtcagttgataaaaggtaaggtctctggaagaagataccagcggatatctttagtagcaggtctcataaatggtgcgcttatagccccgatgacatacaaagatactatgacgagtggctttttcgaagcttggttcaaaacattcttactacccactttaggtaaaccatctgttatcattatggacaatgcaaagtttcataggatgagtaagctaaaagatttatgcgaggagcagggacatagacttttaccacttcctccttactcaccggaatataatcccattgagaaaatatgggctcacatcaaaaaacacctcagaagagtattgccaaattgcgatacttttcttgaggcactttcgtcctgctcttgtttcagttgactataaatatcgcgcgtgttacccaggattcccagaccaatttatgcgctatgccggcaagaaccccagatactatcttcccctgccttactttatataattcaattgacatcttttattcctttcacgtaaaagcccccttgacctgtttgtaccttcaagaaaagtaaatcattgccagatttttcaaactgatagggactatttttctttttccggttaaccaagacatgacctgattgcgactcaatctgcccccgaattccctggcctttgccagtttgtaaagtcaagggagcctgagctagttgcacatacaagtgttggggataaccaccgcaagtcgtcaagcgaatatcctgttgttttttatcccttgaactgcggatagaaatatcttcaaatggtaagtaatccaagcgagcatctgcctgaccaagttccaaatccagcaccgacatccattcctgaggcaagttgattgtcaaacgacaggccaagctactgtgaaaataaagcccctttttttcaacataaagacgaggaagcttatcttctggtgcatcttgattgtagcaaatctccacactaatctgattatttttagacttagccaaagttagacgtccctcagataattttaaaaagagtgattcaatcccttcaaaactataggattgtttcaatttggaggaagcaaagaccttaaaacttggcaaggtaaaattcaattttactttttcttccacaaaaagaaagtctggttcttgattcatttccttaaaacaggcacgcgcctcttccttggtcaagacacctttttcatataactcaattaagcgttcttctctcttttgcgtcatagactcacctcaattctactctagtatatcacatttctccacaaaaaaatcagcccgaagactgattctctattctttcaaagtaagtttaccccgacacttcccacatcggtatttttttaggtcaatgcggcgcttgcgctggtagacttgtccacaggactgacagcagtaaatcagactaggcttagtagcttgttccagttggggagcatagcgcaggccatccaccgcagctagcaattctttaaaatccctgtctccatgccgatagcctttcttctcaaagtagagatggtagtggcagagctcgtggcggacaatcttccgaaagacttctaaaccttgctcctccaaatgcttgggattgaaatccaaatgcccatcccttggaaaaaagcgaccacctgttgagcgtaatcgcctgttccagattgctacatgccgaaattccttaccgaagtcttgcaaggagacttcttgcacatacttattcagatccatttggtttcaaaaggctaagaccgatacgatttcgtttgatgtccacttcaaccacccagacggttacgatttccccaactgcgagaacttcgcttggatgtggcaaggcttgttggcgtccatttttatctcgtttgcgtttgaccatgcgtgaaatgtggaccagaccatcctcgtggacaccgatgtccacaaaggctccaaagtccacaatattgcggaccgtaccttgcaattcctgtccgactaccaggtccttgacatccaagacatcttgacgaaggactggtgcttcaaagtcatcccgtaaatcacgaccaggtttgagcaagtctgcgatgatgtccttcaatgtttcttgaccgacaccgattttttctgccgtatctgcgatggcaagctgcttcaatttttcctgcgcagcctcatctaagtggtcaatagctagaagttctaacagattttccacagccttgtaagactcagggtgcacgccagtattgtccaaaaagttagtcgcatcaggaatccgcaagaaaccagctgcctgctcaaaggccttgtcacccaaacgtggaacctttttgagttgctgacgagaggtcagagcaccgttttcctcgcggtacttgacgatgttctccgaaatggtcttgttaagaccagcaacgtgagccaaaagggcaggactggccgtattgacattgacaccgacctggttgaccaccgtatcgaccacaaaatccagactttcagacagagacttctggttgacatcgtgctggtactggccgacaccgatagacttgggatcaattttgaccagctcagccagagggtcttgcagacggcgggcgatggaaatggcagagcgtttttccacagggaggtctggaaactcatatcgcgccagttcagaagctgagtagacagaagctactattatagcatgaaagcggtacaaatggctcaatagaaaaagcacgtagataaactacatgctctcaatagctaattaaaattcagcctgatccgggtcaagtcgaccttttactccttctagtttatccaactttgcaactgctgtcggactaatagccaagccatcaatttccaaattcgccttaatattttctggactagttgatttcgggagagggagaaaacctttatctaaagaccaagctagtgccagctgggcaacactacaaccagcttctttagccaaatcggctgcttcttggctttggaaaaggcttcctgtaccaaatgggctataggcctccaagagaatccctttggctttgcagtaggccactaattctgactgaggagttcctggggccagcataatctgattagccatcgggataatctcagccgtttccagcaaagcttctagatggtgttccataaagttagaaactccaattactttcacttttccagcacgatagagctcttctaatgccttccaaacctgggcattgcgttccttccagccaatgctgtcgcgaacagccttgggatttggccaatggatcagtaacaaatccagataatccacctgaagtttttgcatggattcttctactgaagcaagggtatcttcatagccaatcttgtcattccaaaccttagttgttaaaaaaatgtcctcacgagctagaccactatcagctatagctcgaccaacactagcttcgttgccataaatctgtgccgtgtcaatgtgacgataaccagcttccaatgcataagaaaccgcaccgtacgtcacttcaccatcgggtatctgccaagttccaaaaccaattttaggaacagttacaccatttgaaaacgtatatcttgtcataaaagacctcctatttcttctatccccagtataaactaaattgtcaatcaatacaaaataatgcgacctaaaaataaaagacacccgaaagtgtctgctcacatttattgtatacttacttttcaaaatttattttcttggatagtttgtcgataacaacagctccaactaatagagaaagcaattctcctgctgctgttgtcaaccaagttagaaagaatggtagatcatataagacttttaattctaaagcaatggtaaacatagttgccgcaaaaaagaatgagaaataaaagaaagccttgttaaataatccaccgaatagatagtccttcttgtatttttcaaacaggataactcccaatgtaacgaagattaatgtcgagaatccacccacaaagaggtcaatcacaccaaaaccaatcaagttagaaatcatgcagccaatggtcacggcgataatatacttacgattataaaaagccaagaaattgagcatttcagacaaacgaaactgaacagccccgaaggaaatagcattcaatggcggtgtcaaggtaagagcgacataaatcgccgcaacaagagcaatttctgccatatctctggcagtccatttagatgtattcataaaattctcctttagcgaaaaagcttaaaatatgcttgggtaaagtgagcaagccccaagggtcattgaatttatcaacaacgttgattagtatagcatatttttgctaaaaatgatagactagtcctatgaaaaaactattttatcaactcatcaataacgaagttattctctatttgattgcaggtgtggcagcaacccttgtctatatggtcactcgaatggggctatttttagtcattccttccattctattggttactcttttagccaatgcagtagctatcctctttgccttttggaccaacgaccgtttcgttttcaaacaagccagagagggttggcctcagcgattggtcaagtttgtatctgcccgcatcgcgaccttggtcatggatatggctctagcctatttattagtacaagcctacccacaattgattgggcagtttgtcaaccatgatttgacacttgtcaacgccatttccactctcttctctcaagtcttggtcattgtggtcaactatttcttgagcaaactctttatctttaaaaatacgaaatgaggctccaacggaacctcatttttatatatagcttgattttcctacttcattctttatctatcgctgtaaatcttgcctttagcctattcaagatagaaacaatatccccatctctggcatgaaactcttctacctgcatactttgaaccgtagcattaatcattgcaccaatgatgagtacctgagccataaaaatgaaccaaagcataaaaacaagaaagacgacagctgttactattctaaaatccagcaacttattagcataattatcaacataaatcgaaaataactttccaatagaagtcatcgtcaacagaacaaataacgttcctggaaaaacatatcgaactttttttatccgaacatttggcaaaaagaaataaagcataaccaaggcggtaaacagagccattaaacctactaactgtgtttgactaagaagccccttcagccaggcgtcttcaataggaaccagcttattaatataagaaaaaactgcctgcccgaaagtcaaaagcgtaatacttaagaggataattacctgcagaccaattcctaaaaatatgccaatcaagtgcccaataataaaatcacggtgttcattgataccataagccttattaaaggccttctgcaaaatagtcatactacgtgacagggtccaaagagttgtcagaattgaaatccctaaccacgatgacgacggctttgttaatacagaagtgataaaagatgaaaccgaaggatagagcttgtctggcacaaattcagctacaaccgataaaatcatatccacatcaaatggataatatggcagtaaattcgcgagagttagaagaatagggaaaatagaaattaacaaatagtaagctactgcaacgcttgttacatcgctatcagcagaacgataaaaagaaaagaaggttgagcagaatgttttcaaaccttcaactattttggttttcttcattctctcctccttcctcattcatctattattcacgaccacaccgagaattaataggtcccttcttcaccttgactggtcaaaataaccggtccatctttggtgatgacaaattggtgttcgtattgacaagacaaaccaccatcaagtgtcttatgagcccaaccagtcttcatatccgtatcaatttcccaagtacctgtattaatcataggctcgatagtcaaaaccataccttcacgcaagcgaagaccacgacctttagttccataatgaggaaccatcggctcttcgtggaaggttggtccaacgccgtgccctaccaagtcacgaacaacaccgtagccaagaccttccgcatattcttgaatggcagcaccgatatcgccgatacgattgccaacaactgcttgctcgataccacgatacaaacattccttagtcacgtccatcaagttttgaacttcctcagagacctgaccaaccgcataagcccagcaggaatccgcacaaccaccacgataggtctgggtgattttcttcatagccttgacatcattaaagttgagcttagaaacatcaactaccgctttatccaaaggctcgctcaaaaccatatcgaccttcagtaaatcaccttctttaagtttgtaatgacgcggaaaagcatgagcgacctcgtcattcaatccacaacaagtcgcataaggataatccatcaattctccatcaacaccaatttggagtggcaaaacattcttttccttacacgttttacggacatattcctctacttcccacatgtccacacctggcttgataatctctcgcaaaccaatatgaataccagccagaacatctccagcacggttcattgcatcaatttctcgttgtgatttaatggtaatcattgattctcctcatacatttctaaactaaattcagccctcttcaagctaaattttagataatttcttgttttatggctatagcggtcacttccgcgatactgcgcaacctgtaccaaaccagcttttttcgccaccatctgactggccacattttcctcatgggtgacaataaccagctccctcagaccaaactcataaaaagctagatagactaaagtcctcactacttccgtcattaagcctcttctccagtagtctttttttaggaaatagctgagctccgcagaaagttgacgttcatctaccttttcaaagcaaagcgcaccaatcatcctctccgaatacttatcaactaaggcccagtttcccaatggtgaacgcataaatttttcaaccattgtcgaaaaagcaatatttctgtcctccaaagctggaaagataaaaggaagattttcgggatttgatacaatttcatagaaactttctccatcttcaaaagaaaatggtcgtaaatacaaacggtccgtttcaaagcaagcaaacttcgctagtcttgtccaaagtgtcatagtgtacccaaggggctgagaattactcccagccccagattgtttcgttttttaaatcgattacgttttgagaaagtagttctcaattagactctctaatcctcaatcaattgaatatctgcacccaattctgtcagtttatcaataatatttgagtaaccacgtagaataaactcaatgtttgtaatttctgtacgcccttgagccattaaaccagcgataaccattgcggctcccgcacgcaaatcagtagctttaacagatgtaccagtcagttgatttggaccttcaaaggcaatatggttgttacgagtagagatttttgctccaagatttgcaagctcctgcacatgaccaacacgtttttcataaatcgtatcaacaatcgtaccagtcccttctgccttaagcagtaaaggagtaatgggttgctgcaagtctgtcgcaaaacctggataaggtgaagttttcacacttaccgccttcaatttctcttgcttttcaacaaaaatactatcttcagaaatggtcatgcgaacacccatttcttccaacttagcgatgtaactctctaagtgttcataaaggacattatcgatacgaataccttcaccaacagcagcagcaagggcaatataagtccctgcttcaatacggtctggaatcacctgatgacgtgttccttttagactatctacgccttcaatggtgataatatctgtacccgcaccacggatacgtgcccccatattattaagcaaagttgccacatcaataatttcaggttcacgcgccgcattttcaataactgtacggccttctgctttgacagctgctaagatagtattaattgtcgcaccgacgctgacaacatccatgaagatatgtgccccttgaatacgctgaccattagttgccaagcgcatatagtcaccttcataggttgtctcagctcccattgccgcgaatgctttcaagtgcaaatcaatcggacgcggtcccaaatcacaaccacctggcaagccaacaacagcttgaccaaagcgaccaaggagggaaccgtaaaaatagtaggatgcacgcaagctattaattttgccaaatggcataggcatgtcttttacaccacgagggtcaatctccaaggtttcaccatcacgcttgaccgtcgcgcccattgtttccataatatcaactaagctatctacatccgagattgcaggtactccgtccagagtaacaatcccgtctgcaagaataatggccggaataagagcaacaactgagttttttgcaccactaacggtaaccgaccctttcagtgtttttccaccattaattacaatttttctcatactaacattcactttcttaatttgcctaaaaaggcatacgtttcattctatcataaagtcttggaaaaagctagttatatagcatgcaaaaggaccgagccaatgagctcagtccttcatatttatatacgattagtgaatctctcttcatcatttatgaaaaattctctgaatttgctcccttgcatccacgagatacaactccagctcttctctcgttaaataaggtactcgcccatagaagatatggtcaatgacttgagcaccgttgctattgaagagccattctgaggtcagggttttcatcgcttgatcaatcggtgtcagacttccatctgcattttgtggctgccctgttggcataaagaaaatagctttcttagtggaaaataatttacgtggttcatcagattcaaaactgtaagcaaagccatgttgaaatacacggtctacgtaacctttcataatagcaggcattccattccaccaactcggaaatatatagactagtaagtcgctttcggcaatcaaatccatttcaacttgaacatctgctggaaaaacagttgcctgacgtacaaatttaccatcctcaatatgaatggtatcttctccacgtaacacgggatcgaatcctatttcgtataaatctcggatgacaacttctgctccattttctagcagagcttccgccactctatcaaccaaagcatgtgtaaagctttcttttctagggtgtgcaaagacagacaattaacgctttcataaacttctcactaagtggacaactatttcattacaaaaccgcagttttcaaggcttccaccttgtccaatttctcccatgggagatcaatatcggtacgtcccatgtgtccataggctgcagtttgcttgtaaatcgggcgcttaagatccaacatctggataataccagctgggcgcaaatcgaaaatatgacgaacagctgcttctagcttgctttccgctactgtgctcgtaccaaaggtatcgatgcgaactgaaactgggtgagcaacaccgatagcgtaagccaattgaacttccgcctttttagccaaaccagctgcgacgatattttttgcgatgtagcgtgccgcataagatgcagaacggtccactttggtcgcatccttaccagagaaggcaccgccgccatgacgagaataaccaccataggtatcaacgataatcttacggcctgtcaaaccagagtccccttgaggtccgccaatgacaaagcgaccagttgggttgataaagtagttggtttggtcatccagataatgagctggaatgatttccttaatcacacgttcaatgacatcctgacgaatttgctcctggctaacttctggatcatgctgggtcgaaataacgactgtatccacacgaacaggttgattatcttcatcgtattcaactgttacctgtgacttagcatctggacggagataagcaatttcaccagattttctcaactcggccaaacgacgcaccaatttgtgactaagtgaaattggcaacggcataagttcaggcgtttcatctactgcaaaaccaaacatgagcccctggtcacctgcaccaatcaaatccaatggatcttgactagcatcttgacgagtttccaaggcttcattgacgccttgggcaatatctggcgattgctctacaagtgacggatgaaccccaaccgactcagctgaaaaaccatactcaccttttgtatagccaatctccgcaatcgtatcccgtaccacacggttaatatccacataggcagtggttgaaatctctccaaacacatgaacactacctgtataaacagccgtctctgccgctacgtgcgcatctggatcctctgctaaaatagcgtccaaaatggcatctgaaatctggtctgcaatcttatccggatgaccctccgaaacagattcagacgtaaacaacttacgttctgacataaaaatgtcccccttaaaatagaatatatgctagaaacctagcgggttactaaggttacaaagaactagtcaaagactagttctttgcgaaagacaactgtcttaagcaaagggaaatttccagatacccaacgagaaagacaataccagactatatgagagtagcctagctttgaagaaaatagtgactgaagtgtagtaaagtttttacgcttactattcaatattaccagtttctttaattgtgtttcaagtgtttctgcaaatattaactagtctataaactaccttttcgggacttaataacgtttctagtatagcatagattgaccgactatcctagcattttcttaaaaataaagagggttgttctatgcaaccactcttctacaaaatcattagataaattcggcatctgcaaatgcctgtttaaccacctctagaggcaaatgaaccaactcacagcccttttctttatacaagtactgagcatagtcatccatgcggtattcattgatatagacaacccgcttacaaccaacctgtaacaattgcttagagcagttgagacagggaaaatgagtcacataggcagtaaaaccttttggaattccccgctccgctccttgtaaaatggcattgacttccgcatgcaaggttctagcacaatgaccatcaatcataaggcattcctgatccaaacaatgttcggttcctgaaacagaaccattgtagcctgttgcgataaccttattgtccttaaccaaaaccgcaccgacttttgctctcttacaggtcgcccgattggcaatcaaaagcgcctgagccgcaaaatactcatcccaagctaaacgatttgttgacatgatttctcctttctccactcaatccaccatcccataaatctctgccaagtcctgtgctgtgacaataccaacaagatcctctggcgaatgaagcttcccactcgcctgacgactgactaggacggttgtgcgcttacgcccttcaaaatgattaattacctgataaagatgggctgttattggtagaacaatcacctgaatactatcttcctcacaagctagtacgtcttcaagactagcctccaccaatttttcacgtatagagcccgtttccttgcttgccttggccaaccaatttgtcaatcccttgtcagaaaccaggccttgataaaccttgtcagaaaaaataggaaacttagaaaaatgctcttgctccacaatttctaaagcctttgtcaatttgtccttgccctcaaaaataaccggcttaattttctgggtcttttgcaaatagtcggcaatggtaatcggttcttggtactgggctatcactttttccaaaacagtgatcaattcctgcgaaggttgggctacttccttcaaacctgttcgtttctcatgaaccatgagattacgcaactgacgagccacatagagtttatcccagttcgcctcaacgggattatgtcgcgtcaattcctttgctttggtcaacatagagcctacatctgcatattccccatccgcaacaccgcacaccttacgcaagaccttatccaagtcattgaataactctaaaaaacgggtttcattcatcttaatctaccattgctgatttcaaataggcatctaccatccgctcagtcgcaactacagaatccaaatgcgtccgttcataggaatggctagactcaatgccagcaccaagcagtgcatgcttgacatctgcacctgctcgcatagctgccgaagcatcggaaccatagtaaggataaatatccagcttataaggaattccatctctttcagccaaggctatcaagtgctgacgaagttcataatggtagggacctgatccgtccttgacacagatagaaaccgtgtactcatccgtctgctggtcatctcccattgcccccatatcgactgccaaatattcaaccacctgagcaggaatgctggagttggcaccgtagccaatctcttcattgtttgaaaaatagaaatgtgtcgtataaggcaaggtcgctccctcttccttatagaccttcaatagatggagcaagatagctgcggataccttatcatccaagggacgactcttgataaagccagtttctgtcacgacggtacgaggatcaaaggagataaaatctccgacttcaatacctaaggcctgcgtctcgtccgcattggtcactttttcgtccaaacgaatttccatgttggtctgattgcgctcagcggtactggcatcccgatagacatggacagaggtctggtgcatgagaatagtacctgtgaaagtcttgccatttttagcgcaatgaattaagcagttttctccctcaatagaagggtatccaaatcctcccaccaaatccattttgagtcggccatccggtttcactgcacgaaccatggcccccagtgtgtccaggtgagcagtcaccatacggtgttcctgatcattttcccccggaactgtcaccaaaacaccacctttagcggtcttactagcaacatagccgaaactttcaacctctgccttgatataattcataatatccgtcgtaaaaccagttggcgacggagtgttggtcaatgtaacaatgtaatcaagtgtcttcatgaaaacctccttatttaaaactattatatcacgttttaggtgatttttttgctataatgaaggtatgaaaacctatcagaaaatatatctccttttaaaagagagagaggattatgtcagcggagaagatttggcacaggaattgggcatttcacggacatccatttggaaggccattcgccagttagaaacgcatggtttaactattgaggctgcccgtaatcgtggctacagattagccgaaggcgatttactcctacccgaattaatctctcaggagcttcaactacctgtccatctgaatatggatagcgactccacccagctagatgccaaacaaggtattgaatcaggtcatactagtcctgccctatatctagctccctatcagaataaagccaagggacgatttgggagacccttttatgcctccaagtcaggtggtatttatatgtcgcttcgtctctctcccaatgttccatttctagaatttaagccctacaccattttagctgcagctgctgttgtgaaggccattcaatctctttgcgacttggacgtccaaatcaagtgggtcaatgacatctatctcggacacaaaaaggtcgctggcatcctcactgaggctatctcttccatggaaaaccaacgggtaaccgatgtcattatcggtgtcggcatcaatgtccgcatagacgatttccctaaggaattacaacaatctgcaggaaatcttttcgaggaacaaccaccatttacccgcaaccaactcattactgccatctggaaagccttcttagaaaccgatgagaaggaactaattgccctttacaaagaaaaatcacttgtcgttggccaacaagtgagctttgtagaaaatcaagttgaatttaagggtactgccatcgctgttactgatacaggaaacctggttatccagttagataacggcaaagcaaaaattatctccagcggagaaatcagccttacttcttggtctgcttctccaccaaacgaataaatttagtcaccttgtaagcaaaatgaagattccgataggcgataaaggcgtagatacctgcaatcaagaaatctcctgtcaaaatcgatgcattcataaaataaacagctaaaatagttgtaatggctaaaaaaagaaattgtggaagtttcataaaatagattataccaaaaattcagtcaactggctgaatttttatatgctttcttgataggtttcgattcttttctaaacaagaaaacaccaatctaattggtgctttcttaaggagatatgaaaaatatttaggattgaatatagtataaaatatctatcaaaactattcatcagtcttaggactgatattttctaatcatttctaatctcaactgtatctgcgagaaagccaaattcttctgggactggactggcttctttttcgatttcctgtgtcttttgcccttttgctttcgccgaaaattcagcacgaatacttacccaatcttcctgagcaatagctaaaatctgtggggaaaaaccagctgccttgctgagaatatttccaaacatggtattgagattgtcacgcttcatcgtctgttcagcattaagcggagaatcaaaggctagaatcgcatgattttcattggcagcaactggctgggaaccaaccaacaaggcacgatctgcacctgacagactctcgataatttctccccaagcattctgcaagcgagtcaaattttcacgcgccaaggttggattttccatagcttcctgcaaaatagcatgaaccttgctggtatccaatcggtacttcttcggagcctgcggcttgcgtgaaactggcttaacagcacttggttgactagataattgacttagttgtttctgtaaatccgcaacttgttgttgcagactggctagttgccccagtaaatcagctggcagctctgccattgcctccgaaggagaactatcttcagccaaacgaatggtcatcatttcagcgtaaatcttgggttgaggactggacttgatgtccgccaaacccctggtcaccatctctatcatggtaaaaatccgtgcctgctcaagagctagattttctgaaaaaactgttgttaaatgcgtatcctctccacccgtctgcacgataaggacatctctcaaatagtgcaaaagatctgtcgcaaaacggctcatactctttccttggtcaaacaaggtttgtagatgctggagagctgtgacactatccccttgacgcagacttgccacatagtcatccaaggcacgcaagctgatagaacccgtaatttcctcagcaatttccaaggtcacttgctggtcctgactaaggctgagagcctgatccaaaatagatagggcatcccgcatccctccttctgcccgacgcgcaatgattgtcagagcctgttcgtcaaagattagcccttccttggttaaaattgcagccaagtgctcctgaatgtccgtcaccttgatggacttaaattcaaatcgttgcacccttgacagaatggtagcaggaatcttgtgcaattccgtcgttgctagaataaagaccacattttcagtcggttcttccaaggtcttcaagagggcgttgaaggctccagtagacagcatgtgaacctcgtcgatgatatagaccttataggtcgcaagactaggtgcataggtcgatttatcacgaatatcacgaatctcatccacaccattgttggaagccgcatcaatctcaatcacatcttccaggctaccttccgtaatggcctgacagatataacaatcgttacaaggctcgcctccaacctgattaggacagttcatggccttggcaaaaatcttagctgccgatgtcttacccgtaccacgaggacctgaaaagagataggcatgactgattttcccttgttcaatggcctgtttgagtgtggtcgcaaccacctcctgccccaccatctccccaaaggtctggcttcggtacttcctatataaagcttggtacattagcgtttttctccaaacatagcaaaattccagtccgtcttctcaaccaagagagcaacgaacttttccagatagtcttggtcaatcgtatcataatcagctaccaatctcgaatccaagtccaaaacgcccagcaactggtcgtttttcaccattggcacaacgatttctgatagggctgtcgcatcgcaggaaatatagttatcatgtagacgaacatcgtctacgagaatagtctggcgcttagctgcaacctcaccgcagacaccctttccaagtgcaatatgaacacaggaaacgcccccctgaaaaggccccaaaatcaattcactaccatcatacaagtaaaatcctgtaaagacagagtttggtagagcttgattgagcaaagcagaagcatttgatagattggctaaagcattggtttccccatcaagaagagcttccaattgagccaacaataattgatagtttgaaattttttcttgttttgtcataggaacattatagcatagttaagccgacttttatagtccgagcgataaagaaaaaggcttgcgcctatttccacatccagtacataatcactgcatcaatcaatacccctatagcccaggctagttgaaaatactttttctgtgtcttatgccgaaaatgggttccacctgcccaggcacccagcccgccaccaaaataggacatgagtaataaggtcttttctgaaatccgataggcgttttttcttgccttccctttatccataccataggtaatgaagacaagtaaattccaaactactagcgccatactaaccatctgtttgattgacatacattcctccaattaagtcacatttcttcttactctaacataatccaaaacaggacacaaggaaaaacgattcggaaatccgaatcgttacatttctgccagtgtatcctctaaccatttgagctgggcacggttgcgttcaatagcccgtgtcaaaatcaaatagtgtccataattgtcttggatactttccttggttgagaacagctcaactttacgactgtctaggtgttttaagtgcttggtgactagttcaatttgactctgcaacaaaccaggaatccgtgggtcatccttttcacggataaaaaacatcttgattgaaaacaagtttttttgctgaggcgtttcttcatttggaatggatagccattcgtctaaaatctgacgaccagtagccgtcatcgcatactgcttttccttttcatttccaggtactgcatgacaagtaatcaattcttccttggtcatacgttttaattctggatagacttggctatgggcaacctgccaaaattcgcctaaatcacgttgaacatagtcggtaatctgcttgccagttaccatttgaccgctagcacccataatccctaatatgatatgaggtaatattctttgcttcggcatcttaaccacgctctcttaatatactctccaccttggtgttaatcaagtcgatggctacaacgttgctgacgccttcaggaatgacgatatctgcatagcgcttggttggctcgataaactggtgatacattggtttcaccaccgaggtgtactgctcaatgatactatctaagctacggccacgctcttccatgtctctcttaatgcggcgaatgatacgaatatcgtcatcagtatcaacgaatatcttaatatccattaaatcccgcaaccgtttgtcttccaatactaaaataccttccacaataaatacatcttgtggttcctgacgataggtcttctctgaacgtgtgtgctgagtgtaatcataaatcggaatatccactgaacgtcctgctaatagctcactgatatgataaatcatcaaatccgtatcaaaagccagtggatggtcataattggtcagtatccgttcttcaaaggtcaggtgagactgattcttataataagaatcgtgttcaatcatagatatacgagcatttgggaaattatccagaatggcacgtgacacacttgtcttgccacccccagatccgccggttacgccaataataatgggtttctgagtcatcatcatctccttctattttcaatactattttaccatgaaacatggtataatgaaaaggataacacaaaagaaatgagaatttatgcttaattttggtattgttggcacctcagacatctctcatcgttttatagaggcagcccatttaagtggacattatcagctacaggctgttttctcccgtagactagaaactgctgctgccttttcagagcagtatgaaggagtcgatttatacacagaatgggtaaaatttctttctgctcccattgatgttgtctatattgccagtccaaatgccctgcactttgaacaggcaaaagctgttctagctgctggtaaacatgctattgttgagaaacccatggtttctacacctcaggaattagaacaattgcgtcgcgttgcccaagaaaataatgttttcctctttgaggctgctcgaaactatcacgaacaagctcaagccattatccgtgaatttttgacggataaaacgattttaggtggttcatttgggtatgccaagtattcttctaagatgcctgaattgttagctgggcaaatgccaaatatcttttcaactgatttttccggtggtgctctcatggattttggtgtctatacgctctacgccgctatcggcattttgggaactcccagaacggcccgctatgtagcacaacagctaccttttggtattgacttaaacggttcgggacaactcatttatgacaactatatcgtccacattcaagcatgaaaaaatattacaagcaatctagcgagcgaaatctatacaaatgatggaacactaacactcaacgcatgccagcatatcagctccgctattttcacaaaacatgacggagagcaaattgttttaccaatccaagcggcccagcatcctatgctcgaagaagtgttagaaattgcacaggcaatcaagcaacaaaaccgcaagcttgtggaccagtggctggctgtggcagaaagcgtccatcaaacactttacaccatgcgtcaagacgcaggaataatctttaaggcggataacaatgaaatctaaatttccctccagctggacggaccagcttaccctacttggctttgaggactttactcctatccaagtccaggcctttgagcctattgcaaacggcaagtcccttctagctatcagcccaacaggcacaggaaaaacccttgcctacctctggcctagcctattagccctaactcctaaaaaagcccaacaattgctcatcctcgcacccaatacagagctggctggtcaaatatttgaggtttgtaagacttggtcggagacaattgggttgactgctcaactattcttgtctggttccagtcaaaaacgccagattgagcgactaaaaaaaggaccagaaatcctgattggaacacctggtcgtattttcgagttgattaaattgaaaaaaatcaagatgatgaatatcaacaccatcgtcctagatgagtttgatcagctgttctccgattctcaatatcagtttgtcgaaaagattatcaactatgtgcctcgtgaccaccagttaatctacatgagtgcaacagctaaatttgaccgtcaaaaaattgctgaagacattgaaagcattgatttatctgagcagaaattggataatatccaacattgctatatgatggtagataagcgtgaacgtttggaaactctacgtaagtttgccaatatccctgattttcgtgctcttgcattttttaacagcctatcagaccttggtgcaagcgaagataaactactctataatggtgtgaatgcagtttcattggtttctgatgtcaacgtaaaattccgcaaggtcatcatcgaacgtttcaagaatcacgaactcaatcttctacttgctacagatatggtcgcacgtggtattgatattgataacttagaatgtgtcctcaactttgaagttccttttgaccaagaagcctacactcatcgttctggacgtactggacgcatgggcaaggaaggtcttgtcatcactctagtatctagtcctagcgaactaaaacaattgaaaaagtatgcctccgtccaagaagtcattctcaagaatcaagagctctacaaaatataatgaacaatatacaaaaggcttagaaccagtgtttctactaacatgattctaagccttttatcattcttactgggctgggccggataattcttgtgaataatagattaattgaggattgagaggactagcgagtaagtctgttacagtaaccatattgtagccctcacctgttaaatattgcaatacagactcgaggctatcaactgttgactgatgaatatcatgcattaggataatacttcctggacaagtctgttcttttatttctttcaaaatggcttggggattgcgactcttccaatctttagaattgaccgaccaataaatcgatggaagtcccatctgattgacaacggcctggttaacagaaccataaggaggacggaccattgttggtacaatacctgtagcttcagtaatagctgcctgtgtatcttgaatttctctctgtacttgctccccagaaatagtgactagattgggatgattccacgtatggttggcgatgacgtgcccttctgctaccattctacggagaatagcttcattcccaactacagccttaccaacaacaaagaaagttgctttggcattatattttttcagtaaatctaaaactaccggtgttgtgttcggattgggtccatcatcaaaggttagagcgacctgtctcaaatgtttcttatccacaacttgtgcagccatatactcatcatagccaaccttatcagcatctactagataatcactcttcactactgggtacaaatctgaaattggtagaaccaactggttgatgccgtaaccatctggtaattgtaaggttaattggctgtctccataactaaaggaaatagcatttaagtctagtgtttcaaattttttgacaatcgcttctacatcagtctctttcattccttgagcaagtaaggcttctcttagatgatcaacaataatacttgctgcagaggataaattaggtaataaatcttctagagtaaacaattcattgtcctgcgtcaataacacacgctcagacgggagtttatcctgctttttaatttgcaagttgtctactttatagtgctccgcttgaatttcacgagctgttacatttttaaaatttgtttttccctctattgatgaaacaaagaccagtttttgaatttttcctgctggttttttatgaccaaagcgtctttgaacataggaaatcattcgactttctacaggtcctaagacatgacctgcatcatctgtaggtaaggcagccacaacatgggtcgtatcaatatttccctcttgaattttgcccttgcctttagcgaggatggtttgttgtttttcctcaataaactgactaacctgtctttcttgaagtcctgcaaataaccatacagccaaacttaccattatgccgagcaaggcgatgttgattcccaaccaaaaactaacttttttcatctccaacctcccattcaaaacatatataaactatgctaaatcatttaaaggctcttgtcaagacagttctataaaaactcataaaaagattaggtaatactcttcgaaaatcaaaattatccgttgtcaactttccttgatgaactccagttccatcttcggcttcgtttcctagactacttttgattttcattgagtataaataattgatttgcttcctaattcccccctcctgccattttctgatttttttttgaaaagaaaaagactgcctaggcaatcttttctaaattaatctgcacgaatgacttccacacggtagccatctggatctgtcacaaaataataacgacctggacttcctggcaatcccttgatgtctgtcgttggatagcccagctccttatgtttcgcattgtccccttctaaatcatctgaagaaagagctagatgcgagaaaccgtcgcctacgatatagggaccatgatcataattgtaggtcaattcaatctcaaagtcatctccttcaagtgctaagtaaaccaaggtaaacttgtgctctggatagtccttgcgacgggtttccttaaatccaaatgcttcttcataaaatttttgagatgcttctaagttctcaacacgcaaacaagcgtgcaacatttttttacttgccataataaattcctcctaccatttaataccaccagtataccatactctctatgaaaaatccgatattcaaaatcatgaccacccgtcaaacgggtggtttgaacaagggctataagcccacatcaccagccagcgcctaaagacgctggctttcactttgttcaagcctcactgcttttgactcgtcactagcctcttaaagaggcattcgtactacttgccattatccctaaagggatcttcatactcttttacactcaacttatcaagtgctatatcatgtttaactcgctttttaagctgaagctcgtgaagaaatcatccactggataatttctttattcttgtatatatttcttaattgtggcttcattaagtccaaccgtacttacataatatccctctgcccagaaatgacgattaccaaatttgtatttgagattggcgtgtttatcaaacatcattagagcactcttaccttttaaatatcccataaagcttgatacacttaatcgcggaggaatactgactaacatatgaacatgatccggcatcagatgtccttcgataatttctacgcctttataagtacacaaacgtcggaatatttctcccaaactacttcgatattgattatagatgatttttcgtctatacttaagtgtgaagacaatgtggtagaacacagccactttgtatgtgataaactatgtgccttttgcgccatatttttctcctttcgctttacaataggcttgaacacctttattgtatcgcgtttggagtttttttggtgtaaccttcgtcgcgcacccgcatagcgggtggtttatttgtcacgcaccttacggagcgtgacggactaaaagtcacataactaaaaaagcctgagcgaactcaggccttaaatgaattatgcttccaagtagtactctttcacaatgttcaagttttcatccaattcgaatacaagtggtgggaagtttggaatttccacatccatgatttcgtcatcagacaattgtttgatgtgttttacaagggcacggattgagttaccgtgtgcacccacgaatacgtttttaccgtctttcaatgctggagcaattttatcttcccagaatggaagggcacgctcaagcgttactttcaagttttctgcatctggaataactgaatcatcaaggtgtgcatagcgacggtcagtgtgtgctgaatgctcatgatctttagccatttctggtggcaaagtatcataagaacgacgccagatgtgaacttgctcatcaccaaattcagcagctgcttcagctttgttcaagccagtcaaaccaccgtagtgacgttcgttcaaacgccacgatttttcaactggtacccacaattgatctgcagcttcaagagccaagtttgtagtcttgatagcacgtttcaatacagatgtgaaagcaaggtcaaattcgatacctgcttctttgatcaatttacctgcatcgattgcttgttgtgtacctttttcagacaaatcaacatcagcccaaccagtgaaaaggttagctttgttccattcagactcaccatggcgagcaaaaaccaattttaccatttatgaattctcctttaaattttgaggttcccctcttatacttctctattttacacgaaaaggtaaaaaaatgccagcctttccacaatctgtgtacgctttcattactctttcatgtaaattcagtctctagacctatctttcttcttagaaaaaatacaaaataatggtataatagtaaggctgaacacgacagttcaaaacgataccactataggagttatcatgaaaaaagtagctatcgtgtctgcctatcgttctgccatcggcagtttcggaggtagtctgaaagatattgaaatcgctgatttaggggcgcaagtcctcgaaacagccttagctagtaaaaacatccctgcagacagcgttgatgaagttatcttcggaaatgttctttcagcaggacaaggacaaaatattgcacgtcaaattgctattcgtgcaggcattcctcagacagcctctgcctatgcagtcaataaagtctgtggttccggtctcaaatcagtcctcctggctgcccagtcaatcatgctaggtgacaatgatgtagttgtggctggaggcattgaaattatgagccaggcaccttatctatccaaaactagcaggtttggtagtaaatttggtcatattactctagaagattctatgctgacagacggtctaacagatgccttcaacgactatcacatgggcattactgcagaaaatgttgctgaacactatcaagtcagtcgcgcagagcaagatgcttttacatacagtagccaagagaaggctgcgaaagctattgctgagggaagatttgttgacgaaattgttcctattagattaaaaaatcggaaaggcgaaactatttttgccacagatgagtaccctcgtctgacgccaattgaaaaattggcaacacttcggccatcttttaaaaaggatggaaccgtcaccgcagccaatgcttctggcatcaacgacggctgtgctgtcttgatactcatgtctgatgaaaaagccagtgagctaaatatccagccactcacctatattgaggcctatgcaacaagcggtttagatcccgcattgatggggcttggacctattactgctagccaaaaagcgctacaaaaactgaataaaacagtcgaggatatcgatctattcgaactcaacgaggcatttgcagcccaatcaattccagttgtcaaacaactcggcattgatcctgcaaaagtcaatgtcaatggtggtgctatcgcccttggacatccaatcggagctagtggtagtcgaatcctagtcactctgattcacgaattaatcaagcaagaaaaagagcttggtctttgctcactttgtatcggaggcggtcaaggcatctccctaatcgtttccaatgcgcaaacaagttaacctatcatttgtacacaaaggatatattatgaacatcggtattgataaaatcggatttgcggcacccgattatgttttagatttggctgatttagcccaagcccgcaatgtggacccaaataaatttaagattggtcttcttcagtctgaaatggctgtagctcctgtcactcaagatattatcagtcttggggcaaaggctgccgaagccattctgacagaagaagataaacaaaccattgacatggttattgtcggcacagaatctagcgtagatcaaagtaaggctgccgccgtcaccattcatggattactcggtattcagcccttcgctcgctccatcgagatgaaggaggcttgttacggtgcaacggctggactaagtcttgccaaaagccatatcgctcaattcccagaatcaaaagtcctagtcattgctagtgatattgcaaagtatggagtcgcttctggcggtgaacctacccaaggtgctggggcagttgccatgttggtaaccgcaaacccacgaattttggtcctcaacaatgataatgtctgccagacacgtgacatctacgacttctggcgtcccaactacgacaaatatccacgtgttgatggtaaattttcaactgaacagtacaccgattgcttgacgacaactttcgactactatcaacaaaaaacaggcaaaaccctcaacgattttgctgccatgtgcttacatattcctttctccaagcaagggcttaaaggactgcaagctattgctcaggatgaagaaactcttagtcgcttgacagaacgtttccaggaagctatcgtctataataaagtcgtcggcaacatctacactggctctatcttcctctctcttctttcccttttggaaaatagcagagcgttagagacaggggatcaaatcctcttttatagctatggtagcggcgctgtctgtgaaattttcagcggtcaactcgttgaaggttatcgcaaccacttacaagaaaatcgtttagaacaactcaatcagcgtacaaaactcagcgttaaggaatacgaacaagtcttctttgaagaaattacccttgatgaaaccggttcatcccttgacctaccagaagaccaaagtccctttgcccttatcaaagtggataatcacaaacgtatctatcgtaaataaaagccaaaacggcgccctttggctctcaccaaggggcgctttcctatagaaagaggaacctatgtcaactttttccggattttataaaaaatcacgccaagagcgcattgatattctccgtcagaatcgttccctagccgaagatagcttagacattctatacaaagacgaaaacctgccagaagcaattgcgggaaagatggcagaaaatcatctaggaacgttttccttacctttttctgtacttccagaacttctagtggatggacaaacttactctgtaccgatggttactgaagaaccttctgtggttgcagctgcatctttcggagccaaaatcatcgctaaatctggcggttttacaacgactattcacaaccgtatcatgattggacaagttgctctctacgatatttcggaccatagcagagcgacacaggcgattcttgaccataaggagagtattttagaaaatgccaatcaagcacacccttccattgtcaaacgagggggcggtgcaagagaattgactgttgagagtaaggatgagtttttgattgtctatcttcaggttgatgtacaagaagccatgggagccaatatcctcaataacatgttagaagctgttaaggatgacttagaagagctcagcaagggacaggctttgatgggaatcctctccaactatgcaacggagtcactgatcaccgcccaatgccatattgccatctctagtctggctaccagctctgccattgctcaagaaactgctcaaaaaatagccctggcaagcaaactggcgcaagtggacccttatcgtgctgcgacacataacaaagggatttttaatggtatagatgctgtcgttatcgctgcaggaaatgactggcgggcagtcgaagccggagcccatgcttatgccagccgtgatggacaatacaaggggctttctacttggtctattgatggcgagcacttggtcggctccatcaccctacctcttccgatcgcctccgtcggcggctcgatcgggctcaatccaaaggtagcagtcgcttttgaccttctccaacaaccaaaggcacgccaattagcttctatcatcgcttctgtcggtctctgtcagaactttgctgccctgcgtgctcttgttacttcagggattcaggctggtcacatgaagctccacgcaaaatccctagcgctacttgctggcgccgaggagcatgaagtagaccaactagcccaactcctgcggaaagaaaagcacagcaacctagaaactgctcaaaacttattagcaaaaatgagagaacattgggagtgggaaagacatccatgatggctccgccctcacccacagaataatgaaaacgaacataaagccctcactaggtgtataatcttagtgagggctttgtggttgacgagttactgatgttagtcatcgcgggaaaaactaacccactctactgacgagcaccccaaaatatgcgataggcatgagtataaaaatacgactacaattcggtagataagctctctaatttttagaaggagggaattatcatggaggttctctatcaatcttgtgcaggtattgatgtccatcaagccaatattgtcgtctgtatcctacatggaccactcacctcaactcgtccaaagcgtgagatggctacatttgatacaacgactaaaggcctacgtgcttgccacgattttctcagtcaatttcatgtggaagctgttggtatggaaagcaccggtgtctattggcgacctgtctggcatgctctatgtgatgacttcgagttgatactcgctcaaccagcccacatgaaggctattccaggtcagaaaaccgacaagaaggacgctcactggattgccaaattaacacggattggtctgcttcctcggagtttcgttcccgatgaaaccattcaagaattgagggagttgaccagacaacgaaaacattatgtggaaagtcgcaatcgagaaacaaaccgtatccataaaattcttcagtcaggtggtatcaagctaacaacctatattgaagatattatggggctatctggtcgcaatctccttcagctactggttgatgggacgcctattacacctcgcattgtccatcaatcagtttacaccagcttgaagaagaaagtgccgcagcttctggaagccttggatgactatttttctgaccatcaccgctttatgttaaagcagtccttagagatttatgatttttatcagaagcagattgagttgttggaagagcgaatgaatgtctatctatcacaatatgaaaaacatgtagaaatattggattccatcccaggcattgatgtcattacagcttctgttatcatttctgaggttggagttgacatgagtcagtttccgacatttggacatttagcttcttgggctggactctgtccaggtaataatgagagtgctggtaaaaaacgaagtaccaagattcgacacggaaattcatatttgaagaaatgtttatgccaagcggccttcgctgtcaaaagacaaaaaggcagcccattagcagaacgatattatcagattcaaagtcggcgtggctcacaaaaagcaaccattgcacttgcgcatcaactattaaaaatagcctatatccttttaaaagaacagatgacttatcctgaatttttagcacaaaaaaaaagactactagggacgagctagtagcctaacataaaaaatttttcgctttgattatatcatagggagggagtttttgcattcttttgagttttcgtataagaactcgaccaagataaaaagagttcgtcttcccacccccgcacagttgattaggccagatttggagtgcaaaacacgaacaaatctgccaatcaaccactgcgctgagatgttgacacgaactctgagtagtggtcctgggctttttgcccagcctcactctattatttgctccatacggaacttttgtggtttcattccttggcgttcataaaaacggacagctcctgcattgtcagcccatacatccaaggtaagattgtggcaaccctgctccttagcataggaaagagcaaattcataaagctgctcgccaattctttgaccacgcgcagaattggctacacacaaatcatcaataaacaaggttttaattggttctaaaacatcgcctgttgcggtagataattcacaaaaaagatgcccaaccacttgtccctctaactcaaagacaaaaataggcttatctggattttccaaaagtgctactaattcagcctcagaaaatttttgacctgcacttttaaaaatatctggtcgtgcttggtgatgcacctgtaaaatatcttgaagcaattcatttaatatcggaatgtcagattgtctagctttacggattgtcataatactctccttttgagtttttattattatagcacatgttcattttttaacaaaataggtctacagaccgatgaagaatctgaaaattcgagtatactataggtgtatcctaaaatttttcataaatctcctaaaaaatcagctggccaaggctggttttttgttgtcttaaaacgagaatgtgtagtgtagaaaactactaaagtttctctctctttgacgcaaaatgcttttgcttcatttccaacctcccagagtcactcccctgactctgggagccccaaaacacagaaacatactaagattagtagtgaggaaatctccgacgggagaaagtactcactactttttctttatgataaagtagaggtgtcttgttaagtcgtagggctttttgacgctagacgtcgcaacaaaaactggcaagacacctgttttagaaagaatgttatcaaagtatgtgggacgccagacgtcgagtattgaaaatgacatcgctaaaacaaggaatcattcaagacaaagaggtaatatcatgcgagtagtttttgggattgatgtgagtaaggcaagttcagaagtggccattctagtcaatggtgagaaagttcatggctataccatatccaatgacgccatcggctttgctcggctacttggcgatttgagaaccgtccataagccagaaatcatctttgaagcaacaggtgtctattctcgccgtctccaaacttttctagatgataatggctatgcttatacacggcttaatcccttagaaactaagaagcaactggatagcttgcgtgtgcggaaaacagatcaaattgacgctgaaaaactggctcaatctcaatttgtgctgaatcgtaaacccacttatgtccaagaagaagtctaccaaaacttgcgggatctcagccgtttctatcagaatctgaccgaggatattgttcgagctaaaaaccgcctgcacagggtcttacaggtcactttccctgaattggaaaatatcttatcgacaccatctggcgaacaatactggaacttagttatagcttttccttgtaaggactgcgtacttgagttaagcaatgatgaactctcaaagagcatccgtctgtccacttcaaaacggatttctgacaagcgtgtggcttacttagccgagaagcttatagcactagctaatcaatcttattgtgccgtcaagaaaacctctccaatactggaagaggtccgttactatacaaaagaattgcttagactttctgaacagagacaggcagtcttagacgaaatggtggaactagctcagccattacctgaatatgacattctgctctctattcctggaatagctgagactactgcaacaagtattattggtgaactgggagatattcgccgttttcagtctgccaatcaaatcaatgcctttatcggtattgacctgagacactatgaatctggtaacttcctcgctaaggaacacattaccaagcgtggcaatccctacgctagaaagattctgttcaagtgtatccacaatatcgcttcagccagtcataccaatccttgccatatcgcagacttttatgagaaacgaaaaagacaatcgcaaacgacttcaacgaagccgcacacgattgcctccatacatcgtctcattcggacaatgtattacctcattatgcataacaaactttacgattacgcttcaacccaaaatcggtaaaactgtttatgctctatcattgtaacaccttatcaaaaaatttcaacataaggtgttggttttgtatgcactttttacactaaaatgtagtccaaaataaaacaatttccttattttgactattgaactcaaaatatttttcgtcaaataccttgatggacttgacaaatagtagaaaaaaagcccgtcggacaagctagaaagcttgatatgacgggctttttgatgcttagcctcgctcttttgtttttaagcgagggataaaacagtctatccccagactgttttattttacagcgtctttaagtgctttaccagctttgaaagcaggtactttagatgctgcgattttgatttctgcacctgtttgagggttgcggcctgtacgtgctgaacgctcacgaacttcaaagttaccgaaaccgatcaattgtactttttcaccagctgcaaggtagtctgctactgctccgaatactgcatcaacagctgctgctgagtcttttttagtcaatgaagttgcttctgcaacttttgcaatcaaatcttgtttattagccatttgctaagtcctccaataattttctgagttattactcacttctatatagtaccgaattttaggcgtttggtcaagtttttaatgctattttactgtctttttctgtagatatcaacaatgaattggtcgttgtacaaatcaatcgtattcgcctttccatacagaccaaatttgttcttcagttctgtcagttgaacctgtacttgcgcttgttctgagtctatttttacaaaggcaggtagtttataatttttttgtaaataagctaatacctctgctttcggcaaggataaacttccaactgatatttctgttatccgtaacaaaatactgccatcttccattttgctaggttgaaaataaatatagagtgggatagtcacaccaaaaatctgatagctgccttcaaaaacaacttgctgactcgttacgaataattgataggaaaactcttccgtctgatactcttttagatagttagtgagggtttggttgagctgttccctattagtggagaaggtcccaacctttgtgtcttctgtactagtctgaacgagctttgttaaatcctctctatctgtttgaatccgtgtatagaggactattccgcaaccaatcaataaagacaactgggctaaaaataaccatttccaaatattaaggttcccagctttccgtggtctcattcattctctccaatatcgcttttttcataatctcatatccagtattattgggatggaaactgtcttcctcatacagtaaattattggtaacttggctaccattttgactaataccagcctccccttccaatcctttataaagcaaatcattgatcggaacaaagtagacatgctgatatttttcagttatctgttctgtcatcgtattccaattatcaacaattgtctgcatttctgtcaattcaggaaaattgaggtagagtggattgtaaatcccgacaacatagatgggaagatttggattattcttacgcgctgtcttaataattgtatccaattgttttccgtaatcttttgcgggcttatcaaaagttgaaactttgagattggcaatgtttttaataatagccttgcgcaaatcgttgccaccaactgtcagagttaacagatctgctgtttttaagtaacttatcagctctccatcttccttcattcgtttaagaatctgattactggtattcccagaaactccgaaatttttataatctacttcataaccataatcattagttagagattgagccaacaagggaacaaatcccccctgtccagttgtatctccaacaccttctgtcaaagaatcaccaagtgccacatatcgaaaactgattttttctgatacggtaagctcttgtctggagatgcgagatgaggcaacaggaatgagctgatgaaatagaaaaatcgaccctagaattgtcagaaaaaagaaaacaaagccttgaatcaacttcctattattcataacgaagcaaaatagcccaggcatcctcaccagtatgagtttgaatgatggaacctgtctctaaaacagaaatttcttttgagacgtactcttgtaattgactcttcatttcatttgcaaaatctgccgttcctgaataggaaataccaatctcggctacttttttatctgctagagttgccgtgaactcttccagccattttttaaaggtcttattgcctcgtcccttgacaatcggagtcagctgatggtctttcatttccatgatgacacggatattgagtaggctactcagcatcccttgaacacgtccaatacgaccacccttgactagattttctagggttgatacaccgatgtataattccgttttttctttgactgtttcaatagctgcaaggatttcttctttgctggcaccagcttgtgccatgcgtgctgcttctacaacttggaatttttcagcctgatctgtaaagcttgaatcgagtattgtcacatcagcaccagaaagggttgctccttgtctagcagcttctactgtccctgacaaggcatgcgacaagagaatggcaataatctgactgccgtctttagccaattcagcaaaagtttccgcaaagagtcctactgggggctggcttgtttttggcaagtttttcgacccacgcatgagctctaagaattctccttcttttaaatcgttgtcagagtatacgactccgtcaaccattacagataatggaacaactgttatattcaattcttcgaccaaactgggttcgatagtcgtacttgaatccgtaacaatcttaatctttgacatatttcatcctacaattctcttcaattttgccatctattataacaaattttaactaaaaaataaactttggacataagcaaaaaggctagtcgcctaacctttttctactaattcttttgcttgattacgggctgcatctgtgattttgtcaccggctaacatcttggcaatttcctcaatacgctcttctttggtcaagagacggacacgagaaacggtcgaatgttcgtcggatattttctcaataaagaactgataatctgcaatagcaatgacttgtggtagatgagaaatcgccaatacttgcccatattgtccgattttataaattttctgggcaatggcctgggccacacgtccagacacccctgtatccacctcgtcaaagacgatggaagtcttgccttctttacgggcaaaggctgacttaatggccaacatcaagcgagacaattctcctccagaagccaccttaaccagaggcttgaagtcttcacctgggttggtagagatgtaaaattctactgtttcatttccttctcgattaaattttcctttagtaaatcgaacttggaaacgagctttctccatatacaagtcttgcaattcttggcggataatatcttctaaaacaacagccaattcatggcgtgattggctgagctgacctgctcgttcaaccaattctttctctaagttcttaagctgaacttccaaatcatctccagataaatcattgcctgtcaatagattgtattcttcgctgattttactaaaatagtccaaaacatcatcgacagttccaccatatttcttcgtaatggtattgagcaaatccagacgactttccaattgcatgagacgattgccgtcaaaatctagattatcgaccacatcgctgagacgcttggttatatcttcaacgacataataagcttctgtcaggctagaagagagctgtttgtagtctggatcaaattcttccagactttgcaagtcactcatagctgagcgtaggttgttcaagcttgaaaaatcttcattgtctaacagtgcataggcattggtcagtgtatctgcaatttgtttgtggttgagcagtttatcgcgttcctgattgagttgaatatcttccccagacttcaaatccgctgcttcgatttcagcaatttggtattctagcatctcaatccgcgccttgtgttcttgctcatttttttgcttttcaagaactcgtttgcgaagactacgataggcatcaaaggttgtctgataacggtctttaagactccaaaattcatcttctccgaaactgtccaaaagacggatatggtgctgggatttcatcaattcttcctggtcatgttgaccatgaatatctactaaatattgcccaatctgtttcaagacagataaattgaccatttgtccattgacacggctgaccgaacggccattttgcaggatttcacggcggataatgagttcgtcagctacttcaatcccctgttcaagcaaaatttgctcgagagctctgctattttcaaaggaaaagagcccttcaatctcagccttggcggccccatgtctgataacatctgtcgtcgcacgcgcccctagcatcaggttcatggcatcaatgataatggatttacctgcacctgtttcaccagataggatggtcatcccgttttcaaaattcagtgatacctgctcaataatggcgaagtttttaatggacacttctagtaacatggctaccaccctctaaccgtctgttcgatttgcgaaataataccttcgtttgtaacaatgagcagaatactgtcatcatcagcaatcactgaaaaaacatgttcttgaaattgttccaaaatctggcgtttgaccacagcagagcttccaggtaccagacggagattaatcattttatccatcactgagacttcaaaaacattctgcgattttaccttaacaagacctgcctttggtaaaccataaatatatcccttatctgctgatggaaccttaataatgccaagttccttgatatcacgtgaaaccgttgcttgtgtcgcattgacacccattgcttctagacgttcaacaatttcttcctgtgtatcaataggaaatcggactaccaaatctttaatgacttctaatcgttctcgtttattcatcctttttaaattcctcatgtgcttgatagactgtagttgttatgacctctttatcaatctggtttggttgtgttgatttttctaagtgcgctaaaaattcgatattgccatgaccgccttgaacaggggaaaagctaagggctttgactgagaagcctgtttccacggccatttttgtcacttcttccaagactttcaagtgaacggatttatccttaacaatgccatttttcccaatctgttcacgtccagcctcgaattggggtttgacaagggcaacaacctggccaccctccgctaaaatacgatggagtgctggcaaaatcagactcaatgagataaagctgacgtcaatggacgcaaaacttggttgaccaagttcgaaatctcccaactcagcatagcggaaattgtactgttccatgctgattacacgttcgtcctgacgtaatttccaagcgagttggttggtccctacatccacagcatagacctgcttggcaccagcctgcaacataacatccgtaaatccgcctgttgaagccccaatatcaatcgttgtttgaccctcaactgataagtggaaaacctgcaaggctttctccaatttgagaccaccacggctgacatacttgagtttttcccccttgagcttgagttcaattccctcgtcaatcttctcacctggtttatcgtagcgttccccgttaatgacggatataactaagccagccataacaccgcgtttggcctgctcccgcgtctcgaaaagcccctgtttaaaagctagtacatctactctttccttagccattgattcgtaaactttctatgatttctttgattttttctgttgaaaatgggacttgtttagccacttgatctagctcgttgattgcttgattcaagctatcttctagaaagacttttgaggcttccagtcccattagggcagggtaggtagacttctcagccaatacatctttttggggagtttttccgatttcctcaaaagtggctgtcacatccaaaatatcatcccgaacttgaaaggctagaccaattaattgacccgcttgtcgcaaatggttgattaccacatctgattgtcctgcaatcaaacctgctgctacaaagggaaatgtcaataattttccagtcttattggcatggatggcttgtaattgttctaaggtcaaattctgcccttcaccagccatatccaagacttgaccagcaaccattccaaaggtcccagatgcctgggaaagctctctcacgagagcaaggatggtctcagctggtaaatcaacttgggctaggaaaccaaatggatctagaaagagactgtcccctgctaaaatagccgttgcttcatcgtaaaccttgtggttggtcaagcgaccacgacggtaatcatcattatccatagcaggcaggtcatcgtgaatcaaacttcccgtatggatcaactcgacacatgctgccacttggtaatgagcttgttttaattccatcccaaaggactctaagatggtcaataaaagcaaggggcggattcgtttaccaccagcctgtagcgaataaagaaccgattggttgaggcgttcagctacctggggttggtaaaagtctgccatggcttcctcaagtcgctgcaatttactggcaaccattaatccatctccgcttcactgccatccgcctgcatgaccttgaccaaggtcttttcagcttctgctagtgtcttttgtaggtctttcgatagaaccattcctttttgaaactcggccagtgcttcttccagagccacatcgcctcgctccaatttggttacgattccttctaattcagctaagttttcttcaaatgttttcgtctgtttggacatgttttacctccacatcaagttgaccatccttcatctggatggttaggttttcacccatttgtacattttctacactatcgatcacccgaccatcttgacgaatcatggcgtagccacgggctacgatgcgactggtatccagcatagtcagggcctcaatcagcttgtccgccttggccatcttattgtcatagatattagccatattgctcttcaagagtcgttcctgctggataattctctcttggaaactttctactttacgacctggatgcacaccttgtaatcgttgctgtagtaggagacaagcctgtttctgctggctgtagagttctttcatccgtgtctgcaattgattggtcaagcggtctaatttttgcaaataaccatcatacaagcgttcaggctggcggaacatgactgactggctaattttctcaagctgacctcttaggaatctcaaacgattggtcatggcctgataggctctattttcctgctgattgaggtagcccagtaagtccgccttggtcacaggtgttgctaattctgcggcagctgttggggtagcagctcgtttatctgctacaaaatcagccaaggtcgtatctgtttcatgacctacgctggaaatgattggaatacgggattcaaaaatagcccgaaccacaatttcttcattgaaagcccaaaggtcttcgatagaaccaccgccacgaccaacaatcagaacatccaagtcatcccgttcattggctctttgaatattagtaacaacctcctgagcagcaccatctccttgcaccttggtcggatagagaacaatctctacgcctggaaaacgtcggctaacggttgtaataatatcctgaataacagctccactcggactggtaatgacaccgattttcttggtaaaccgtggcaaggcctgcttgaattcttctttaaataagccttcctgtgtcagagcttgtttgagctgttcaaacttgattgccaaggctccaataccatctggctcagctttttcaatgacaatagaataagaaccatttggttcatagagctgaatgcgcccaatgacattgattttcattccctcttcaagctcaaagcccagattcttatagacgcctgcccacatggtcacttggatgactgccttgtcatccttgagcgaaaaatattgatggctagggcgtttacggaagttggacacttgacctgtcaaatacaccttctccaaatacggatcgcggtcaaactttaattttaaatacttagttagatgactaaccgataaatattcaaccatgtccactccttctatattgtatccctactattataccaaattttgcacttttatacagaactaggcctattatttccgatagctttcctatgttttttttcaacaatttgctatataatagtttgtgagaaaataagaacttgttgacaggttctaaggagatttatatgaaaattgatgatttgcgaaaaagttctaacattgaggaccgcaggggacaatccagttctaactcatctttctcgtctggttcatctggcggaaatgttctattgggactaatcttttcacgacttggttggaaaggaaaactacttgttcttgtccttttagtagccttcggaggcatgtcaaaccttggtgggttgctttccccatcaacagggactaatccttaccaatcgagtcaagtcacaacgactggtacagatgtgtctgatgcagatgctgaattcatgagtaaggttttaggatcgacagaagatttttgggtccaagaatttaaagccaatggtttaacctacaatgcaccgactatggttttctatactaaccagacccaaaccggatgtggagttggttccgcccaagccggtccattctattgctctgctgaccgcaagatttatattgatacttctttctatcaagaattatctagcaagtataaggctgctggtgactttgccatggcctatgtcatcgctcatgaagttggtcaccatgttcagaatgaattagaagttcttggggcctaccatcaaaaacgggctcaactatccgataaggaaggcaatgcgctaaatgttcgtttagaattgcaagctgactattatgcaggagcctgggccaaatatgttgatggacaaggcatcttggatgctggtgatattgacgaagccatgaatgctgcccatgcagttggtgacgatactcttcaacaggaagcctacggccgtactgttccagacagttttacccacggcacttctgagcaaaggaaaaaatggtttaatctcggttatacctatggtgaccttgctcacgccaatacattctccgtagagaaaccgtaaacatccatagcctctcgtagcaataaagaaactcttgcaacatacacttttgcaagagtttctttataatatacaactgacaaaagccaatttacacatacggtaccacttttaaatatgaaaactgaatcatgtaaacttactcatcaactctaattagagcggtatcctagtttcaaacaatatcacaattattatttagcaaactttaattatttccagttatctctgctgcagactgcacagttccgtttggaataatcactgttttcaacaaattattttcctcgtgaatacgtctgtataagataaccatgtagactgggaataagatgagaaaactatatgttgcatgacacaataaagctaaaccgattaattctggtataatatttaggaaatagttaggatgctttacaacacgaaacaaccaatgatcaacaaaacgatgatcttttaccaacatgagcttaactgtccaaatatcacctaacaatcgtgttacccaaaataacattcccattgaaaacagcaagaatatcaaacctaagctactaagcgtatcaaacttggtgtgtcgcactactgcttcaaccaaacatgataaataaaatagaatatgtacaattgttaataatttagtattttgaacaccaaattctgaaccgccgtttttcaaaatccgtttttcgtttttaattgaaatcttcaaaaaatagattctcaccaaaaaaacacaaataaccaaaaaaacaatcataaatccctcctgtattttaacagattttatcaaacacatccattatacaaagttagactgtcgccattctattcctctcctgttttttttctattttccatttgagactacaataaaagagacctgttttcaaaaatggatgaaatcatgtctcttttatagtcttttagtttacttttagtaccagtcaacgagctgcagacagcttgtacagtcgagtgactgtgcaaggttggagatagcacttgcggagcaagtcacccctgcagagtacagcaaagcgagttcaaacaatccagtggagtgtttgaagttggaaataaggaaacggagtttcctcttacgtcgaagtaataaaagaaaaactaaatattgtctatattttacctatatcaattcattactattcgctgtactttgtgattgcaaatgaatcataaaacgcatagtttgtgtatcagaagcataaaaagtgtacggaaagccgtgtttttctaatattttctgtacaataaacaaaccaatccctatgccaccatctttcttatcacgactgtagtctggacgatagaatggacgaaagacttgatccaattcctcgtcacttaaaacacgttcaacctgattttcgattattaattgattttggcgtagtactacacgaataatagcctctttacatgagtaccgaaaggcattatctaaaatattcttaatagcttttaagaaataaacaggatttgcctcaatgagaaccggtgatagttctacttcaaattgatagcccttaacctctgccaaactctgataacttgttaaagaggaatcaatcaactgatctaatcggatttgttctctgctttcctttaaagccatatcaagatttgtcgcttctaaaatagaatgaactaactcagattgttcctgcaagatttccttgcatttttttaaatatgtatcatggtccttaaatggccccacattataaatcatgccttcgactaaccccaacatactagctattggagtttttaattcgtgtgatgtgatacggaggaaatcagacttctccttctcacgtgccatagcacgttcattttccgttcttaattcatcgatacttgacaataacttgctatacaggctgttaatatcctgagccaatattgttatttcatcagttcctgcaacagcacaactgattccagactctaacgattgcattcgtcttgttgtttctgaaattcttgctattctacgagtggacagtctactgtaaacaaaagctaccgaaactgccagaacaataatcaacagcaatatgaatggataaaaagttaccaatgtttgactgacatcagataacgagtgaaatccataattaaataacagataatatgtaactccttctgcagatgttatctcggctccccaagaaccaatttcatcaaaatccccattttctaaatactcgttctcatgctttttagccatttcatcattggggtctggataaataatttttctatcactcgaaaaaagactaataataatattcggagtttttatgtcgaaatcatcaatctcagatataatcttagcttctggcatcccatccaattgtttagccacagtcatataatcgtgtctcaattcctgtttcttaacctgattataatatataggcatagtataatacaataaccctaacaatgttacagagatgaaagaaatcatcgcagcaacaataataaaattttttctggcaatccccatattaagtaccctctatttgataaccacgaccaactattgtcttcaaaggaagtgacggcaatttcttacggatattcttgatatgattatctaagacacgactatccaattccgtatatccccatattcccatcatcaagttatcacgactaacaattttcccacgtcgtttagctaaatatagtaaaacttcatattcttttttcgtcaattgaacttcttcttcttccatataaactgccccgctagttggttgaataagaattgttcctatctcaatgctatctgtctctccttttcctctcaaaatattctcaatccgttttaccaatatagttggtgaaaatggtttaacaacataatcacttataatctgattaaaactaataagctgtgtatattcgtcacccatggctgtcagcatcaaaattggaatctgagaagttttgcgaatttccttcagtacttccaaacctgtcatagatggaatcatgatatctaaaacaattaaatcgaattgttcttcttgaaacctttctaaagcaacctttccatcaaaaacagattctacctgataaccatgttcttttaaaaactcacaaacaacttgactaataactatgtcatcctctacaaccaaaatccttgacatttttatacctcctcgtaaagttctattataaaatattattatacttcaattatataccgattcgtacaatggtgcaactctatcatagataaatagagcaccatgttctgctatttcagctttcttttgacttcttttgtttaaaacagataaaaaacagacgaaaccgagagcatatatagatttgtttgataaactgaactaaacaaaaatgaaaggaactatcccattatgtggagtccaaaaaaattaaccgtattaaaatggtttgatattctcattctaacaattattttatttggagatggaatcatcaactctactctccaatacatagccttacaaaatcaaactacaactcttcaagaaaatttgacattttcaacaatggataattataaggctttggctctacagttagtttggctcacaatagccatcttctatctattactccgaaattttgatttctcaatttggaaaaaacatatttttattactccttgggttccattacaagctgttgccttattcattttttctgcattatgcttggatatctataatctagtatcctatcagtttctagcttccaacactccatccatgtttcaactatttcctaacattgatttatcactgatcttgtactcattgttgaacggattttatgaagaaattttcttccttaacttgtgcttactggttaaccctaaatatgcaaaatgggcatttttatattcgttaattattcgatgtagtttccatacctatcaaggtttacttagtgcactcggtttaggcttaattctaggaactattttctatctactttatcaaaaaataaaacctaaaaatttattaccatttttcctagcacatgctgtggctgatgttatcggtttaactattctatcatatattctatactagttatctaacagataatttgaacacaagctatcctcatatcaccaaagactgagtggacccctactagtcatgaccacccgtgaaaacgggtggtttattttgtgtaatttaggaaaagagtgccaaaaaacgcataaaatcgtgttgctaagaacgttgattttatgcgttttattatatgacttatctcaatatttttattgaaatttatatttatgcccaactatacttctcagaatcaatgtccatatctcatctcagcctagtatagattgacagatttattctacattcccagttcagcctctgcagctattgcgaatggctcgttttatattcaatctccaaagatttcctaaaacttggatctgtacggagggtaaaacaattccatcactattataggcataatctctactctattaaccatatgtatatacaagtagaaattacacgaccaacatttacttcgattcttgcttacgttttgtacgataaagtacctgagctcctacaagaagagagagggcagttaacgtatagattggagaatcagcttgtccagtagatggaagcgagtttgacttctcggttgaacgattcacactagatactttctccacattgtcagaaagacgtgatttctgattcatagcaagctctacctgatttgccaccgtttcggcattcactttatccttgatagtagaaattggagcagagttatctgaatctttaatagtcttagaagaatctggagtatcactattttctgctttaccaatctcttcagttgactctggttccattgggcgagacaaatctggggtatccattacttttggaatatccaatttttgtgtacctgctgaactgtctgtatcttcgataggcttaggtgattctggtttaacactgttttctgtttcaccaatttctttaggtgactctgacttcattggaaaagtggaatttggaataataatattgtccgttgctttcggaattgttgagtctggtttatttgctgaatcatcggttgagtcttcgataatcttaggtgattctggttcaacattatttcctggtttttcggtctcttcagttgaatctggcttcattggaagagtgggatttggaataataatattgtccgttgttttcggagttgttgagtctggtttatttgctgaatcatcggttgagttttcgataggcttaggtgattctgtctcaacattattacctggttttccagtctctttaggtaactctggttgcattggaagagttgagtctggaacatttggttctgtctgtttaggcatttcaggtgtcaccataggtgtcatattttctacttttgatatacctgttgacttgtctaccaccttatctgtatcttttggctcaataggaacaggaaccaaaactttcttagtttcatggttaagagacacttttgaggatgagtattttgctgttttttctctatcattattaagagaataacgaacctcagttcttaccaattcttggaaacctttattctttttattttttttatgttgcaattgatatgttaaagatagtggcttgttagtttgataagccttgattaagtcttctttatctaagttccaagtaatagttgttttcgagttagagaaaaacgaccataataaactagatgtaccatttgtgatttttactttagaactatctggttttttcgcgaactcaacatcattttcaagcgaatctactaagctcactttagtcaatacatctttaaatttttctgcaacattctcgtcaatatttaaaaactcgcccttatccccagacatttttttcaagtagtcatcaaatttattcttttcttcgccagctttgtctttggtcacatcaacagcgtagaaatgaatccctttctcagtagcaatctttgcttctgcctgagcagagaggttatgattgtaaaagacattttttcgaccgtagaaaatgtaatcaacgagggaatttgcaaacaagtcaattgctttttcagaggtatttgtcaaaccaatctttttaccgatataactgagagtatttgtaggcaatgcagccttatctaattctttttttaaattatactttattttctttacaatagcgtctttaaatggtaatggatcaagtttacgttcataaaagctacggaaatggtacccctcaccaatttgtttctcataattgaatttttgttcttctaatttggagctatcaatatcagctaagtcaatatagtctaacgggtttctgaaaaactttccaataaagtcagttaaacctgcgacagtagatactccatctaatgcctcattaaaccttgtaattcccaatttattcaagaattcaatcaagctcttggcatcttttaacaaatttgctctgcggacagtcacatcaaatgtaaatggccaaggcaatagagggttagtatgcaccactttatcttcattgattgtcttatacttagtttctgttttcgcagcatccgtcaaatcataactaaatgtagactccccttgtgacagaagtacaatatgtttgcgtttccctgatttctcgctttctaaaatgcgacgtgcttcatggattgctccctgcatatctacgccccaattgtaattttgttcagcatcagtgaaaagcttctcaaccgtgtcttctacagtaatactgttaacctcttgagcttcagataacttgcgattgaaaccgatcacacgcacagagttacgagaattatgattattggttgggtcagtcatttctttgacaagcttgacaatgttatctttagctgcttttttagcctcttcatccatttttttatatgtatccaccaagacaactatttctgcacccttatcaatttctttcggcacaatttgagttgttactgtgacaactccatcttgccctacttctgctgttcgagaaactgtaaaaagctctttaggagttttatccactgtactagatactgtttcatttggtttttcaaccttagtagaatagtcatctacttccttctccacatactgaacggctggttcttctttttctgttgcttttccttcagaagaactagtgttttcagcaacttgccccgttggctctgaagcgttttcattcgttaatgcctcaggagaagcagattctgcattcgattttggtaaggcagaaaatagaagaggagtcaaccacctctccttccttattttcattagcttggacaactttagggtcttcaacagcaataggacgtgtaatcgaagaagtattatctatctcctcattttttttctaaagtagtactttctgtaacaggcgtttctgcatatactgtcactgtattttgaggatagagtgttcccgataaagctacccccgctcccagcgaaacaagtccaattgatagcttccgcaaagtgaattttggatgattcattatgattccttctccttgttctctataaatttagaatgtattttcgcccttctttaggtattttcaaaaaaggaagtatggatgtcaatggtaaataactttagtatcattttgttcaagaagcgtagagcttttgggaaaagaatgggcaccttgtgtattcataaggtgcctaagtccttctgttaactgcttacttcacctatcaagtcaagcaagcatgattacaactcaaagttcctatttatcattaacaatgaccatatcacaaaatgtgcgagtctattactacataattcattctaccatataatttaaaaacagaatttgttttttctctatcgtttgtttatgtttattctattacaaaaatgataattggtctttgagtctgttatcacacacatttatacaagtgataaatattgcaatgagtcttcaaactctactttcacctctataagcaaataattcattgaaagaaaaattttaactcttttaatttaaagctacacaatgcctctcatctgtcgcaaacgaatttttgagagagctttgtcatcgccttttactcactttctgttatctttttcttgccaatgaataaagcaaataagaataatatgatcgataacattatattggcaaccaagctcgttttttcaccggtcttaggcaggctttgaacttgggtattctcaccactatcatgcacagatacgtttccttttgtccctttgtctcttacagtacgagccattttctcttgcttagtaggcatatcttttttcgaatcatcaaaaatagaaaccgtttcttcttttgatggctctgcattttgctctacttttttgtcagtcagcgtttggcgtacaggtggcaaagtagtttgctcaagtgtgtttgattgttcgatatttttggtaatttctttgctaggttgctcttccttctcgtcctttttatctggtttattaatgcggtgaccatttcctttttgaaccgttacgacttcccaagctacctgttcaccttctttatcaaacgctctaaacgataaggtttctccattttttaaaacacgactacccaaatcaaattcgaatcgacctgttgaatcagttgaagttttaccaattatctcctcgccattctgagttgatactagttcaatcattacatctggagctgttttgccactgatgtaaccatgatctgtagtgactttttctacttgaaatggtaaatccatcacgtcttcatcttccaaatattgccctacaacttcttccttactagcgatgatattatttgtaaccgggtcaatgatttcaaagcgaattctctcacctttttcaaaaggcaattgtaaatcttgaatttggaaaccaaaaaatcctaattcgtccacttgaactggaggatactgttttcctttgattgacgaaaccatgcgaacgtaggcattaagatgtatcgttcgaccgacaatataatcttttttattatgcagtttaggtacaatgataggatcttcatctgtcgcttcatccatatctgcatcttgtaaataagttgctaaagatgccataacagatttatccaataatatacttgaaccatcaactgtatcaagatggacagataccaagtcctcttgttgattgtgagtcaatctgtagtacttatcctcggattgtagggcaggcaaagcaatcttatagtgacctgtctcatcagcaatagcttccatgataaactctgaagtatcagcattgtatagatgcacacgacctaaaggaaatgtagttccttccaaaactgaagtcgcacttgataaaggttttactgtcatttgtgaagatactttttcttttaccaatggttttacaatagtattagtaatcaccggctgaccatcttctgatacaaaagacaaaaccaatctatcatctgctttaaattttgaacctgctaaactctcggaaaaagtaacctcaaaccgtccatctttaggatcaattagtgtcttatcagagacaaaactaccatttattgatagatagactgaacctttgacagaggtatgaccaataactttgctcgtatgttcaaaaactggttcgatgaacacttgatgcattccattagatgttttttctaatctttttgctggaatttcataagcctctggatgtcgattagtcctcactactaccttacgctcttcagaatctgcctctagagtccaaaactgtttcggcaaagcactaatttccacagtttggctgtgagcaagtggtttactcaaccgataagaaaaatctcccttatcatctgcttccaaaatattctcaatagaagtaattgcttccccatctatcgtaatcgctacatatccaccaggagtggtattccctgagatggtttgatctccagcttgaatcggagcaacctctagatggttttcaataaatgaaagttcttcctccatatcctccatctcttccgattttttttcttcactcggtacctcatcagtcacttcctcagcttcagcattttccgaaactgtattggtaagcgatgattccgtgctttctaattgagtttcaagagctgtagcgtcagtctcctcagccattgcggtttccatattcatccctgtaccaatccatagaaaagcaattgccaccgaaactaaacccatcttactttttctcaacgaaaaaatcttgctattcatcttttctccttatatctgtattaacaattaacgacacatattgtcctagttttattataaaaaaaacatctcatagaacattgtttttcattagttttttatctgtttcacagttgtctgtaataaatagcatgctacatttcgcaaaaactttgctggttctcatagtcatttagtttttcttttattacttgtaaatacaatttctaagttatggcacattcaaagtaaagaacaagcgcctgaatttttctatgatgcagatcattgtttttatctcggagtgctcgctttaattcgtcaacttatactcaatgaaaatcaaactaggcgatgcatatgcagatagaactgaagtttatcaaatcaagtcaacaatgtctgattttgattttcgaagagtattaaataggagtgggtttatttgtcatgatgccacttgtttattttgttaactatcacttcataaaacatgattgtcctcacaataaaaaaagcacccgaaggtgctaggtaagatcatcctaccgacttcacgttgaggtaggtagaaaaattcattaggcgttgaaagcgtcagtcaactgtggcaccacttgtttcttacgtgaaacggcacctgcaaggaaggcgtggttgttttccaacttgaagttgaaggctgcttctaccttgtccatgttgctaccgagcgcaaggatttctgagtttgagttaacgatgtctgtaatcatcaaaacaaagtcagagtagccatttgctactgatgctgctgtcatagctgcttcgatttctgcttggcgttccaagacttccgcaatgtccactgtgttaacttgggctacacgcacgtcattgccattcaagccaaatgttttggcatcgatgtcaatcaattcttctgctgacttgctggcaaggttggtaccagctttcaagagtgccaaaccgtattcttctaagttgacaccagcaatttcagccaattcagctgctacctgtggatctgttacatgagtagttggcgatttaagcaagagggtatctgaaatcaaacctgataggagaagtccagctacttcttttggaggtattactccgttttctttaaaggcacggtaaacgattgatgatgctgaacctactggctccaaacgcatgtacaatggatttgccgtttcaaagtttgcgacacggtggtggtcaatgacagctgccacttccacttccttgatgtctgcgatagactgttggaattcattgtggtcagtcaagatgacttggctaacaccttctgcttttgcagactcaaccacgcgcggtgcagtaacaccaaaatagtcaagagcaaaagcagtttcttcatttggcgttcctagaactactgcttccgcatcacgaccaaacacttcacgctccaagtgagcccagccgtatgatgatgcaatggcatctgtatcaggattttggtgaccaaaaactaaaaatttagacatgtctacaacctcattttttctaataatctcctacattttaccataaatagaaagacttgtgaacatggacgggtcgggatttgccaaacgttttcaaaaagagtaagatagaaggtagcaatacaaaaggagaaacatatgaaattttcagactatacctatgtccgtccagattatgaagctatcaaggctcaatttactgacctgaccgaccagttggctcaggcaagtgacttggaaacaactcgcacacttgtggcagccgttaccaaattactcaacctggtcgatacccagtacaatctctggatgatccgtcatactattgacatgaacgatgagttctacaatgaagaaaccaagttttggaatgaatattcgccactttttgaagaattgaccaccaactactaccgtatcattgtccagacgccgtacaaggaagaactgtcagacatcttgcctcaaaccttcttcatgcaggcagaaaacaagctcaagaccttctcatcagacgtcattccattattgcaaaaagaaaatgaattgaccgatgagtacagcaagctgattgctggtgcagagattgatttccaaggtcagacctacaacttgtcacaaatggggccattcggtcaatcaaccgaccgtgaagtccgcaaggctgcttctgctgccacaactaccttctttgaaagcaaggaagctgattttgaccgtgtttacgatgaattagtaaaagtccgcacagaaatcgcccacaaacttggcttcaaggactatgtggaatacggctacctcaagatgaaccgtttcgattacaatcgtgacatggttaaggtttaccgtgaagaaatcctcaagcatatcgtaccgattgtacaaaatctgcgtcaacgccaagccaatcgcttgcaggtgccaagcctcaaacactacgacctaaaccttgagttcttggatggaaatgctgttcctcaaggtgaccccgactttatcgtcagccaagcccaagacatgtaccgcgaattgtccgcagaaacaggcgagttcttcgatttcatgattgagcatgaactcttggacttggtcgcaaaaccaggcaaaaacagcggtggctactgtacctatatccctgacttcaagagcccattcatcttctccaacttcaacggaaccagcggtgatattgatgtcttgacccacgaagcaggtcacgccttccaagtctatcgttcgcgttggattcaaagtccagaagttgtttggccaacctacgaaacctgtgaaatccactccatgtctatggaatttatgacctggccatggatggaccgtttcttcaaggaacaagtggataaatataaatttactcacttggcaagtgcccttctcttcttgccttacggtgtcttggtagaccacttccagcacgaagtctatgaacgcccagagatgacaccagcagaacgcaaggcaacttggaaaaaactccaagacctctacttgccagaccgtgactattccgagtcagaagccctcaaccgcggtatcttctggtatcgtcaaggtcatatctttgctagtccattctactacatcgactataccttggcccaagtttgtgccctccaattctggaaacgtacacaggtagatcacgatgaaaatgcttgggaagactacatccgcatctgtgatttgggcggcaccaagtccttcttgcaagtggttgaagccgcaaacctccaatcaccgttcaaagaaggtgcccttgaaagcacagctaaagctgctgctgattggttaaatacagttaaggatagcgacttataaaacacaaaaatctgaatgaatcaaatgactcattcagattttttgattatatgatacttgtccctaacacattaaatctttttcgcatcaatctccgacctcttcactattatcccttaattctattcaagtactcctgataggtctctgtctccatcaaggcctttgcattttccactcgagccttcgttgggggcttggtcccctctagtggatagggtctgcccaactcacgccacttaaattcaccaagattgtgataaggtagcacctcaaaacgttcgacattttttaaggttttaacaaacttaccaagttcaatcaagtcctcatctcggtcagtcaaatttggtaccaggacatgacgaatccaaacaggcttaccaatgtctgatagatattgagcacattctaaaatagtcttgttactgtgacctgtcacaatgcggtgttgctcaggattcatttccttaatatcaaggagcaccaaatctgttacttccataagccgactatatttttccaagtaacgctctgtcttacggaaagtcaacgcacaggtatccaaagtagtgtgaatccctttttcttttgcaagggtaaacagagcaattaaaaaatcaatctggatggttgcttcaccacctgaaacggtaatccccccttcttttccccaaaacatacgaaaacgcagagcttcattcaagacatcttccgccgttctctcagtcgctgctggattgaccagatcccaagtatctgggttatggcaatactggcaacgcatgtgacagccctgcataaagactacaaaacgtacccctgggccatcaaccgaaccaaaactctctgttgaatgaaccaaacctgtcactttacgataatcaatttctgtcatcatctcatcctcatcattttataagactagtatatcacaaaaatgaaaacgcttctatcatttactttctttctttcataaccatcatcttccgcaagaaaaaagctaaaagactaggttgccctagtccttatcggtttcttctttctccagtggtgtaatcaagagttttaattttgttacgcgaccattttttaccttatcgttaataagaactaggtggtgatctttactatctacttcaaaggaaactttctcatcttggctcggaatggtaccgactcctgtcagataataaccagcaatcgtatcaacgttatcactttccaactccatctcaaaatgctcattgaagtcattcaaggtcatatttccttggacgatataggtgttgtcagcaatttctcgaacaaaaatttctgtcttatcggtctcatcatcgatttccccaacaatttcttccagcaaatcttccaaggtaacgagacctgcaactccaccatactcatctaacaagatggccatttgattttgggtatttctcaatgatgtcaacaaatcatccacgaaaatcgtttctggaacgaagagaggctcctgcataatgcggcggatgttgagattgtcaaagccattactgaaagcttctgacaagattttcttggtatgaatcagaccaatgatattgtccttatcgccatcataaacagggatacgtgaaaaattctgcttgaggatagctgccatgatggttgctgtatcatcctcaatatccaccatgaaagcatccgtacggggaaccattacttcacgtgccatcagctcatctaaagagaacacaccttgaagcatttcgatttcttcggcatctaaggttttctcactctttgtcaaaatatattcaatttcatcccgtgtcatttgctcatccgcatcatcaaaattcataggagtaatacggctgataagattcgttgcagctgataataaccacacgaacggactaacaatttttccaaggaaaataatcactggtgcagtgactactgccagattttccttcatattcatggcaatccgcttaggatacaattcgccaagaacgattgaaacgaaggtcaacatagccagtgcaagccagtaaccagcagtttgagctgttgttgaattccccatccatttggcaaatacagctcctaaatcattagccaagctggcacctgaaaggatggagatgaaggtaataccgacctgaatggttgatagaaaattgttaggattctctaaaacttgaagcaagcgaatatatttcctctcaccgtctgctgccttttgttctactcttgaacgattgagggatacaagggccatttctgaggctgaaaagaaggcattgaacagagtcaataagaataaaattaacagttgtaaatagatggtctgactaccagggtcttccatgatgttctcctataataaaatttataacatttccattataccacaaattctaaaaattaacatatttcttgttataattagtccctcatatctgtttatgttacaataatcaaaaggaataggagagcaactatgattatttcgatgaagaatgtccactataaacgacaaggtaaaactattttagaagacatcaactgggaatttagaaaaggagagcgttgggctattttagggctcaatggggctggaaagtcaaccctccttcgtattttaatggctgagttttggaagacctctggtgacctgactgttctgggggtggaatttggtaagggagatattcctagtctacgcaccaagattggggtagttggctcctttttggcagagcgttttccaatcgatttgacggctgagcagattgtcttgacaggaaaatataaatcctccatcctctatcgtgaatacggtcaagctgaattggatgaagccatagacatgctcaaaaccattaaggctgagcacttgatcggtcgggcctatgctagtttgtcacaaggagaacgccaactcctgctgattgcccgaagtttgatggaagagccggctattttgattttagacgaagcaactgtcggtttggacctcctagctcgcgagcgcctgctccaccacattgactacctctgtcaactcccaacggctcctgccattatctacgtcacccatcacgccgaggaaatcactgataatttcacccatgtcctcctgctcaaagatggcatggtcttggcacagggacccaaagaagatatcctgacacctgaactcctcagcgatttttatggaaatcaggtggaattgattgacttgggtgagggaagattgttcattaagccgatattataaaaaacaaatccagctctagttcgagctggattttaatcgttccaccatgaccaaaaatggtggggtattaacttggttgagcggtttgtagagcatggctgtaaagacggtttggtcaagctggctgataaagtctaaaactgcatccttctcaagagctccaccctcgtgaccatagtaaatcatgatagccaagcgacctccaaccaccaatctattcaggactttctcaatggcttgaagggtggttgcaggcagggtaatgactgacttgtccgccgaaggtagataacccagattgaaaatcgctgccttgcattcatccacatactggtctaggttttcgtgtcctgtcaaaaccaattgggcattggtcaagccagctttttctagtttttcagccgttgtagtcagggcttgttcctgaatatcaaaggccacaacttttcctgctcgttgggctaaaaatagcgtgtcatggccatttcccatagtcgcatcgaccgctaggtcctggtctgttaatatttcatctaaaaaggcatgggccatgtgtaaaggtctaagcatactttctcctaattatcgtcaatacataaaatctatcacatctagtatagcatactttccatcttcaaaaaattttttaaaaatcttccatttttcctattccttttgcgaataaataggtatgaagacaattatcctatttttccttggagcttctatcggctccttcttgggattggtcatcgaccgtttccctgaacagtccattatcgccccctctagtcactgcaatgcctgcaaacgacggctcaaggcctgggacttaattccagtcctatcccagctttcgacaaaatccaaatgccgttactgcaaggcgaagataccttattggtatctgggattggaattcttagccggtctagttgtcctgctctgccattttcaagtcctaaacctaaccgaaaccattctcatcttggcaggactagttttgaccatttacgacatcaagcatcaggaatatccttttgctgtctggctcatttttacttttatagctctgatactctcccagctcaactggcttttctgtggctttttactcttggcctatctgactgaaaaatggcaaatcaatattggttctggtgactttctctatctggcaagtttggccttaatatgtggatttacagaactcctctggattatccagattagttccctcctagggcttcttgtcttcgccattttcaaacccaagtctattccctacgtaccactcctatttctttcaagtattcctatcattctgtgcacctaaatcgagtttttctcgatttttttgttataatagaaggcatattagagttcaactccatcaaaataattggagcaccttcttgataggaaggcaaaaggagaaacgttatgacactatttaaggatgacagtttaaccctgcataccgacctttatcaaatcaacatgatgcaggtctattttgaccaaaacatccacaataaacacgctgtattcgaagtctatttccgttcacaaccttttaaaaatggctacgctgtatttgccggtttggaacgcgttgtaaactacctcaacaatctcagctttagccagacagacattgactatctgacagaactaggttatccgaaggatttccttgattacttgtcccaattggaaatgactctcactgtccgttcggctaaggagggcgacctggtctacgctaacgaacccattctgcaaatcgaaggaccattggcacaatgccaactaatcgaaactgccctcttaaacattgtcaactaccaaaccctaattgccacaaaagctcgccgtatcaaggctgtcattgaagatgagcccttgatggaatttggcactcgccgtgcccaagaaatggatgctgctatctggggtacacgggcagcctttattggtggagcatctgcgacttccaatgttcgagctggcaaaatcttcggcatccctgtcgctggtacccatgcccacgccttggttcaaacatacggagatgattacaaggctttcaaagcctacgctgaaacccatcatgactgtgtcttcctcgttgatacctatgatacgcttcgtattggtgttccagcagccatcaaggttgccaaagaaatgggagataagattaacttcaaaggggttcggattgattcaggcgatatggcctatatttctaagaaagttcgtcagcaattagatgatgcaggttttacagatgcgaagatttacgcatctaatgacctcgatgaaaataccatcctcaacctcaaaatgcaaaaggcaaaaattgatgtctggggagttggtaccaaactcatcaccgcctacgaccaaccagctctgggcgctgtctacaagattgtatccatcgaagatgaagatggaaatatgcgtgacaccatcaagctgtcttctaatgcggaaaaagtctccactcctggtaagaaacaggtttggcgcatcacctccaaagaaaaaggaaaatcagaaggggactacatcacctttgcggacactgacgtcacacagatggataatatctatatgttccatccaacttacacctatatcaataaaaccatcgagaactttgatgcccgtcctctcctagttcctattttcgaaaaaggaaaacaggtctatgaacttccaagcctagcggaaattcaaacctatgccaatcaagaatttgataaactctgggatgaatacaaacgcgtgctcaacccacagctctatccagtcgacttggcacaagatgtttgggataataagatgaacctcatcaatcgtattcgcaaacaaactcagaccaaatccatctaagaaaggtatgttatgaccctacaggaaacaatcatcaaagaattaggcgtcaagccaagcattgaccccaaagaagaaatccgtcgctccatcgactttctcaaagactatctgaaaaaacacccatttttgaaaacctacgtcttggggatttctggtggacaagattcgaccttggctggtcgtttggcccagctgactatggaagaaatgcgggcggaaacaggtgacgattcttatcaatttatcgctatccgcctgccttacggtgtgcaagctgatgagtctgacgcccaagcagccctagcctttattcaaccagatgtcagcttaaccatcaacatcaaggaatcaacagatgccatggtggctgcagtcaatgcaaatgggcttgctatgtctgattttaataagggaaatgctaaagcccgcatgcgcatgattgcccaatacgctatcgctggagaacgcaagggggctgttattggaaccgatcatgccgctgaaaatatcactggtttctttaccaagcacggtgatggaggtgcagatatcctgcccctcttccgccttaacaagcgtcaaggtaagcaacttctagctgctttgggagcagatgaaaaactctacctcaaagttcctactgcagacttggaagaagacaaaccaggccttgctgacgaagtcgcacttggtgttacctataaccaaatcgacgactatctcgaaggtaaaaccatcgaccctcaatcccaaaccattatcgaaggatggtggaacaaaacagcccataaacgccacctgccaattactatttttgatgatttttggaaataatactcctcgaaaatcaaaatcagacgttattgacttgatttgatgactgaaaagctcctgtggaggttttcagcctgttcccttgaaatataaaaggaacagagttctaacatcaacttgaaggcgcaaacaatgttcgctatatttcctagcttcaactatctcccagatagttttgatgcgaaacatgttcgctatatttccaaccttcaactatctcccagatagttgaagctaggctacttttgattttcatcgaataataaaaaatggagccctgacagttgaaccgtcaggggttttgttttttattataacttcaaaccataatgaaaaaagcccacgcaggaaaaaatatcctgcgtgggcgtcaatggacacggtgccacctcactatggactcgactagaaaagtccataactttttctcctctaacaaggaggcgcacgataaggggtgcggaccgaactctcattgtttcgaattcatcgaaccaaactcactttactaaaccagacaatccataaaatggatacgaatgcttgtttggcatcagcctatctcataaacctctatcatctattcacaccaaccatagactctctaaagacaaagtgtttattacattttctgattacttgtaattatacgttacaaaatcaaaatggtcaagtgatttttagaaattttctaaacaatttgaaaattcagtttccattgcctgaatccattaaaaactaacaaaaagccactctgcttaagtgactttctaaaaaactgtactcacgaggctgggctcaagcccagcaccgcttctcaaagttagtgtcaccatctcagcgcagtggttgattgggtttaacagtccagtggagtgaaacagttcggggaactgtttcagcccgatcctagaaagggaaaagcgaggttaaaggttggagataagatttgcgaagcaaatctcagcaattcatgttttacactccaaatctgacctctacgactgatgcgaactttgttcgctatatctccagcctccaaaggttccccgaaccttcggagctatgcggaggtgggagtgaaacaatttgaggaactgtttcagctggtcaccttaaaactagaaagtgaccatagaagccgaacctaaatgtctttcccactcccatatcaaagatagctttagctagtcaaggtcatttttaagggaatactgactgtatttcaaaaaaataacgatatgtagcttaaacaatagcattagatggacattctgaacctgtgacggtaggttctaagactcctgtttggaaaggattatccctctctttatcaatgaatagctaaaataggctagtattccccccattgtattggtccataaatcatcgatttcaaagacgcgttgggcatcaatcagcaaatccagtagtaattgtgtgcattcaataaaaagactgatacaaaaactataacgaatcaccgctcgaaggctccgccattcttccctaagaaacaaaagaagaaaaatcagagggaaaagtagaaaaatgttagtgatgttttgcaagaaaatccaccctaggtccgccaaactatctaccttgtccccgttgacgatgctgttgaaaggagttggtaaaagatagagacggccaatttgaataattcctggggtcgagaaatccttatactgtgggtaccaagtctgtggtaggaaacaaagtaaaacaatagccagagcataggctccagctaaggtcttacaaatctgtcttcccagcttggtcaggttcccatctgcttggaagaattttctcatgctcgaatacctgcctttgcttttgcggctgcaatacgagcacgggctttttcacggtctttcttgagcgtattggagcgcaattgaccacaggcagcatcaatatctgtaccatgttcctgacgaacgacacagttaacaccatttttcttcaaaacatcaaagaaagcaagagtacgttccttggttgaacgactgtactggtcatgttcactaactgggttataaggaatcaagttgatataagacaatttacggatattcttagtcaagtcagccaattcctgtgcctgttccactccatcgttgacctcattgagcataatatactcaaaagtcacacggcggttggtcactttgatatagtcttcgattgcttcaaaaagaacttctatagggaatttgcgattaatgcgcataatgctcgaacgaaggtcattatttggcgcatgtagagatactgccaagtttacttggacaccttcacgtgcaaactctcgaattttcggtgctaaacctgacgtagaaacagtgatgtgacgggcaccaattgccaagcccttgtcgtcattaaccactcgcaagaaggtcataacattatcgtagttatcaagcggctcaccaatccccatcacaacgatatggctaacacgctcattctgattgcgctcatccaagtacttttgtaccaacataatctgagccacaatctcaccgctagtcaagtcacgttgcttaggaatcaatccagatgcacagaatgtacagccgatattacagccaacttgtgtcgttacacaaacagaaaggccatagtgctggtgcatgagaactgtctcaatcaacatgccatctggcagttcaaaaaggtatttgatagtaccgtccttagactcctgtacaatccgttgtttgagcggattaactacaaaatgttcttccaacttttcaatcaaagattttggcaagttggtcatttccgcaaaagattggacacgagaacggtagagccattcccaaatttgagtggcacggaacttcttctctccgttttctaaaatccaatcaaccagattggcttgactaaatgcataaattgatggtttcatatttctccctatttctggcggataacaaagttacgcttcacttcattcatctcacgcttgctttgtttacgctcacgtttttgagaacgctccgtttgactcgccttaacaccagcattcttcatagtaaaatgacgctgttccgactgtttgttttgctgcttcccctttttctgacggtcattgcgattacttttgttttcttttggcgcaataggctccgtccgcggctgatttctgttccgattgcgagaacgactccgcttccgacgcggtctattctcctcctcagcaggcaagtcttgtggattcggattggctaagacgaaataagcacaaccaaaattacaatactccgtcaaatagtcgtctaagcggctgatttttaagtctgatttaacatttttatcgtctgtatagaatccccttaatctcagctgctcattgccccaatctcccacaatataatcaaatttgagcatgagttgtgaaaaacgttgaccaaaaatcgtctgatcaaaagcattcttgtaatcttccaaaaggtccaattcaatattttcagatacaaccttatctccgacacgagcaaaactcggaccagggtatttattatagttatacatttcaggtgaaatttcttttttcatttgtcctcctatcttataaaatcttcatacgtaaaaatcatttgattaataatctatctggtcagaatctaaattctcacacttaaccttatcattataacacgatttatctggaaattcttctactttaccatttaggagaaatttctgacaattataatattattctctagcaaaaaaggacgatttactcgccctttgttttcttcaaataatcaatagcctcttgaacagttttcacaggaactacctcaatatctagacctgctttctcggctgcttccttagcttcttcatagttcgttttagcctttggatttttcttcaaaacttctacatcaactggattgtttggtacaaaaaagatacttgcaccagacttagctgccgaaatgaccttcttatcagccccaccaatgtcacctacttttccatcctgctcgatagtccccgtaccagcaataatccgaccatcacgtaagtcaggctctgcgagttgagtatagatggcaagtgtaaacatcagaccagcacttggaccaccaatatctcctgtttggaaatcaatcggaatcgaactttgaacctctgtatgatctacgagagtgatacctatcccgtttttgccattagacaatttgataatcttaccgtccgcagatttttcctgaccagcgctaatataaccaactgttacatcacttccaacctccaagccactcacatatttaatcaaatcaggagaagactcaaatgtttttccattgatactcacaacagtgtcggcaatattaagaacttttttaaaggttgaatcatccgtcaaggcaagcacatagacaccaaagaaatcaagattgacttcttttcctgccaaggtcaaaccttggtacttcgccatattttgcgatgtctccatgtaaaaccgtgctatacggaaatactcctcattgtcggcccctcctgtcatctcttcagaggaacgaactgtcgtatagggatcaaactgagcagcgaatagttgtaaagctgtagcctgttggactgatacataggtgaagttgtaagagccatcctcttggtctatttgattgttcaccgttagtacctgacgaatatcggcagctccacctggactttccagataataaggcagacgaacaaaaacggcaaaccaaatcaaaagagttcctaaaacaatagatgcaattaaggttaacttcctatttttcttcattctttctaatctcctcactaacaatttctggaacataagggcctatatcctgtttgaaatacagcaattctctaacctggctggatgatacgaacttaagctctggcttggcgattaaataaatagtttccaaacctggcgccaactgacgattgtaaaaatcaaaacttgactcgtattccaaatcggtcgcattacgcaatcctcggaccaaatgtgttactccatagcgcttagctacatcgactaccaattcattttcagacagaacgacctcgatattctccattcctacaaaaagcttctccaaaatggcttttctctccaaacctgtcaagagtcctgcctttttaggattggtaaaaactcccacatataatttatcaaatagtccactcgctcgttcaattaagtccaagtgtccattggtaatggggtcaaatgagcccgtaaacaatccaatcttatctgacatatactgttaccttactaattccgtagagtttctctttccatatccccagctctgctatttcctccggaagagagaccgccttatccgtttcgcagactaccataacatcatctgctagtaagtcacgccgacaaagttctgttatcacatcttcaatttcctgctctgcataaggagggtccaagaataccaggtcgaaaggacctcccacactgttcaaagcctgtctagcttccattgctagaagctgaaatttatctgcttccttagtcattgcaatattttcacggataatggcttgtgctcgtcgatctcgctcaaccagaactgctgactccatgccacgagatatagcctcgatagataaaccaccactgccggcgtacaagtcaagaactctaccaccctcaaaatagggaccaatcatattgaacatggctccacggaccttatccgatgtcggtctggttgtttttccatctaacgttttcagtggtcttccaccatagcttcccgatacaattctcataaggtatattatagcaaaaaatgaagctcgttgctgaaaccaagtgcacttcctgctttcctttttgcaccaactttttcaaccttctaccaaatacactctcaaccgctatagcaggaaattattctcgcactattcaacaaaatgataaaaataaaaagcaaggaaattctgttttacgcgaaattcctcactcttatcgtatgtatttaaactagatcgttacaagaaaaaattgatgttgaaatacaaatagctattttttccagtatgctaatacgccataaagaaccagtagctaaaaagtctacggattatctggtgaactctcgtcagctgttggaactgtttctactgactcaaccaggctagttgttgaatccgtcgtttccgccggggcttcagaaactgttggagtttctaccacaggtgctccttcactagtcggaggcactgaagtacttgtactagttgacgccacgctgcttgtatactggcttgttgaactcacactttgatttccatatatattttgattaggcactacataggattcttgtgaggtctcactagcttcagcaaggtccgttgactgactagtccctgtttcagatacttttttctcatcagctactttttgggctgcttccgctctgaccaactccgcttttagcttagcctgtgtttgagcatctgtctgctgtcccactagctcttttacttggtcaatccgtttctgtaatgctgcttttttagtcgcatccgtaaccttgtttactgcagattgtgcctctgcaagtttctcttcagtatgtgttccttctaatacaatgacagcattctcagcatcctgaaataatgtatcaaccgtttttttctgattggacacttgctgtactgtctttgtatcacttgtttcgctttgagcatttttataccaactagcgcctaagctaatcaataaaataagtcccataaaagaaataatgccaatttctgccaatgacaacttttcaaatttcttttccatattttttcccttatccgtcttattgcataagaaaatactctagcctactgacaatgctacttagttgtttttaccttaccattccatccgtttagaccatagcttaaaatatagatttcgttaaagccctgtttcttcagatgaagggctgcaggcgttaccaactgaccacgatcattctcatagattaagacaggtctgtccttacgcaaagcagctgtagactggcgcaattgctggtaaggaatatttctcgcacctaagatatgcttacgattaaactcactcgggtctcgcaggtcaatcaactgacctccgtgtatcttttctgcaaattctgcattatcaatcacagtcgctgcacgacgcaatctccagtaattaaagcccatccaggctcccaatactgccaaaaatactaaaaatacccaaaatgtttccatcactcattctcccttgatttctgatactctaattccaaacgatgttcacgcctcaaaacaagctctgcttccatatattccaaccgatctaagacacctgcctgatagattctatttaattctatctgcatcatttcaatatcgtagagacggttgcccatatagacaattataccaaaccgtttgagtaattgttgcacatcataaagtcttttcataaaaaaattgtagcagaattttaggtgtttttcaatataatactcaatgaaaatcaaaaacagactagctccaaaggtttggggaacctttagaggttggagatagagcgaacgtagttcgttactacttacgcagatagaaccctgttactattttgtttcaagggaacaggctgaaaggctccactggagccttttactcatcaaatcaagtcaacaacgtctgattttgattttcgaagagtataaaaactcagtcaaaaatccggtctataaaaagattggacaaatgcccaatctcattcgtttatactaaccaacccttttcctgtgccaccttaacagcggcggtgcggttttcggcgcctagcttggacaggatagaggtcatgtagttgcggactgtcccgtcagacaggtggagctggcaggcaatttccttattggacagcccctctgccaccagcttgagtagttgactttctaggttggtcaaagggctgcgttgggttaagagaatatccatcaactctggcgaatactccttccgccctgccaagaccgtctcaatggtccgcatgaggtctgcgatggagcgttccttgagcacataggcatccacatctgccttgaccgctcgctcgaaatagcccggtcgcttgaaggtggtcatgatgacaaccttgacaggcaaggcttgaccccgcacccattccaagacatctaggcccgtcttttcaggcatttctatatctaataacaccacatctactggctctttttccaaaagagcaatggcctggctgccgttttctgcctgtaaaacagcctcaaccgcatcttgaaaacacaagagctgacagagggcgtcccgcagcattgcttggtcttctgcgactaagattctcattctaccacctcctcaaacggaattcggatggacaggcgggtgggatttgccagagaaagaaactccaaactgcctttcaccgtcaccaacctgtcttttatggtatgtaattcctgaccagtcaacttggcaaagcccacaccattgtcttcgtagtataaaaccaattcttgctggtctttttcaaaaaccaaccggcatctgctagcctgactgtgcttgagcaggttattgcccaactctctcagcaccatagccagcttgttctggacaggtaagctgagatgctctgctatttccccgcccaagacaagcaaatccactcctgccaggtccaacatctgctgtaaaatctggagttcctctgccacggtgtactgcttgagggactggacaatctggcgaacatcctgcatggagtctttggctaaggtctggagctcctgcacttccttcttggcctggtcaatctgatcatggtctaaaagtgtctggaccagctcagccttgacagacagcatggcaaagacatgccccagcgtatcgtgcaagtcctgaccgatacggttgcgttcattctcagccagcaggagattgatggacgcattctgctcctgtaggcgttgctgaagggcttcccgcttgatctcaatccagctgaaaatcagcaaggccaagccaaagaagtggataacaagtgcaaaagctctcatctcaaaaggaacagggccaaagagagcccagaggataatggccagtaacaagatcccagaggacaccgtccgataggtcggccgagtttccttgtagtaccagcctagcatattggacaggttaaagatgaagagggaaaattgcagattgccccaaaaactcatgacggcgatatagccaatcaggtaaaaccaagccagcagggaatagagcttgtggtcggtataaaagagggagcaataaaccaaggcaaagagaatagtcgctaggacaactgctgttggattgggactatactgggcatagtaaaagggaaaatagagaaagaccatgcccacgaagaacatgagcggcacctttcttttttcaaaaatcacggcttacctcactgttgctcggattttctattcagaactagagcaattcctaagaaaattatcgcatagcctaggacaattagcaaggatttccagagaaaatctccctcttgggcataggtggtcaccagctggttgacatggtagctaggcataagtttacaaatccgctgcacccagtctggaaagagggaaacaggcatccaagagccacccatgatagccagaacaaagtagagcaagtttgccacaaccgacatggcctgttcagactggatttgcaccaagagcaagccgatagctagaaatacgatagaagttacaaggagtatgagtgcggacacgacccattcctgagctgacaaatctactcccttgaccaagccacccaccgcaaagacaacggcaatggaagatacaaagcagagcaagacccgtaccagtttggataggtagtagtgccagattggcaggggtgaatgctggataaaggtcaaccagctattctttctgtcctctgccaacatcatgggaaaggtgaaaagggcaaagcccgacatggaaaaacctgtcattgtcagcatgtaggactggataaaggccttttgcatggctgcatcatcaaaccggaccgttgatgagaaaatcaggaaaaagatgacgggcataccgatagacaggagaaatactcccaaacttctggataattttaccgcctctacttgaactaatgctttcatgattcttcctccctcgtcttgtcaaataggctattgagcagagttttattctgcacttccaggtctgaaatccgacaacctgcctcctgcaaactagcccaaacctgctcaatagctcgggtcttgaagctgaccgtatcttgtttgtagctgatcccattgatttcagccaagctctccaccaccgccgcaaaggcaatcggcaaagtcacttctttttcttgctcctcactccgcatagcaaatggcgtggtatctcttagtagccgcccctgatgcaagaccaaaatccgctccgccgtatgctccacttcctcaatatagtggctggtataaaaaatagtcacaccctgagccttaagttcatggacaatctcccaaaaacgctggcgggtcgaagtatccatgcccgccgtcggctcgtccaagaagagcaacttgggcttgccaattaggcagatgacgaaagccaagagccgcttctgaccacccgatagcttgccggccagttgatttttttgctcttgggaaaagcagagcaggctgtcgatttccacatctgtcagactatccttgtaaatagcttggaaaaagcggagtaattccttgaccttcaggtctgtcgggatagcattttcttgtggtaagactgctaccgtttctttattggaccgagcctgtggagccagaccgtccaacaaaacctggcctttcgtcgcctttctatcacccaacaaacaagacataagcgtcgtttttccagccccgtttggaccgattaaagccacacattctcctgacttgatttcaaaggaaatagtggacaaaatcgtccgtcctttgatgattttttctagtgcttgtacttctatcatttttctacctcctacttcttgaacatcttatagtcttttagtttacttttagtactaggcaacgagccgcaggcataactggaattaggcaaggcgagttaacgaagtaataaaagaaaaactaaatgacgatacatagacagtatatctcgaaaaaggagaccccactagaagcctttgtcatggactcatgtgacaaatgtcatattatactcaatgaaaatcaaaagtagcctaggaaacgaagtcgaagatagatctggagttcatcaaggcaagttgacaacggataattttgatattcgaagagtattaaataatgtagcaaaaaaagagtcctactgtggacccttcatctatttacaacttaggtgcttgaccaagttctgcctgcagcatccaaatatgtttttcaatactagccttagccacattgaaaatgtcgttggttacgctgtcaccttcttcatcactgacatcaaaccccttttggaaaagagcagccagatagcggaacacctctaccacacgcgccaattgctcttcaatcgttacattgtaatcaccaagaacttccttgagctgactattttcactaaactctttaagggtagaaaatggtgccccacctaaggtgattaaacgctcactcatctcatccaaataaccatcaatttcttccatatattcatccatctttggatgccaaatcataaagccacgaccacgcatataccagtgaacttgatggaggattgaatgggctactgataaatcggccaccgcttgattcaaaacagccttagaatcagccagtgatggacgcgggctgaaagacgcaatttctgctggagattgataatatttttgtttcatcatatatcaccctttcttttatttataataattataaataaaagaagaaaaaattgcaagaattatccctcctcctctgaattattggcagacaaattccttgctatattaacttatatacgttagactagtaagtaagaatagtatgtgattttctttttagaaaatcatcgcccccatatgtgtatatcgaggagggattttatgtcagaagaaaaatttgacgcaaaactagaacagctatctggatctgcaaaagaggtaattggtaagctgaccggcgacaaggaaatcgaagttgaaggacttgttgagaaaggaattggcaaagcaaaagagctagtcgaagatgcaaaagatgggcttgaaggtgccattaacggcatcaaaaatgctttcgacaaagaagagaaataaacaaagagttcaatataggtaggattggtcgtgcactgtttgataatgaacattacacttaatttggtcttttacctatagcccgaacaaaaatatgcaagagaggggaactcagacatttacctgtcgagtctaccttctcttttcttatgtcacgaaaggagtatctatgaaaaaaatcgtttttgtctgtcttggaaatatttgtcgtagccctatggctgaatttgtcatgaaagacatgacaagtcaatttcacattgaaagccgtgctacttcaaactgggaacatggtaatcctatctaccctggaacacagaaaattttccaaaagcacaagatttcctatgaccaagataaatcatcacagcaaatgagccagacagatttcgaagcatttgatattatcatcggtatggacagcaataatgtccgagatttacagaaaatagcaccagcacatgcccaaaataagatttttcaattcgcagaaaaatccgtaccagacccttggtatactggagattttgacgaaacctacgaaatggtaaagaaaggttgtcaagactggttggacaggttacagtcatttgatcaagaataagattttctatgtaatatttttgtaatatttgtaaaaaaatggtaaactatttctgactgaactgataatttcttactgtatcctagaaagaactgattagcatcggtcaaatcctatgaaagagtaaaacgatgaaagagttcaaattacctagtataaaatggcatgatataacaagtcatttcacccgtccaaaacttgaaatcctctcccttattattatcctcatctgtgccctctctgtatttacagggcgaattgccagcaagcaagccatgactttcaataatggcgccctgcagtacaacggttatgtggtcgcaaataaaatgaatggtcaaggaaaattgacctttgataatggagatgtctacgaaggacaatttacaaatggaattttccacggtcaaggaacctacacatctgcaagtgggtgggtttataccgggcaatttaaaaacggctatgccgatggaaaaggaaaattgaccaccgaaggacaagctacctacgaaggaacttttaaacaggggatttatcaatatgaaaattaaatggttatccgttatacgtgtgattggattagtctttgtcctactctatcatttctttatcaaatatttcccaggtggctttgtgggggttgacctcttctttaccctgtctggatatttgacaaccgcccttttgattgatgagtttgcaaaacataaaaaaatagatattgtcagctttttcagaagaaggttctatcggattctcccccctctggttttaacgattcttttggttcttccacttgctctgcttgtccgcaatgatttcattgccaatatcggcaatcagatagtcgctgcgctcggattcatgacaaacttctttgaaattctatcaggtggtagttacgagaatcaattttcacctcatctatttgtgcatacttggacactagccatagaagttcagtattaccttgtctgggctggtttagtttggtatcggactcgcatctcaaaaagtgtggggcaactacgtggatcaatttttctaacatctataagcctcttctcgctaagttttttagcaatgtctatctcaagtttctttgtagataatttctcaaccatttactactcgagcttcacacataccttcccattcttcctcggaagcattctcgcaaccatcgctggtatcggaaatacaacaactgccttccagcaacaagtgaatacattgagtatcaaacaagctataggtctgtttcttggaggactaggagtagaacttcttcttctctttactcttcaattcagttccatctggacctatctaattggttttcttctatctagtttagctacagcaactatgatttttgctgctcgggtacttcacgagaaaaccgaagatgtcaaagaacctgcaattatcctcttctttgcaagtatttcttatggtatctacctcttccattggcccttgctcattatctttacacaactgacaaatgccactatcgctgcgggattatcctttgttttttctactatcctatcaactatttccttctatattctagaaccatatattgctggtaaagtaggaagcttgtttggattagcaatagacttaaaaccctataaaaaatggcttcttagcagctttgcttgcttgaccatagttggcttaggtatctgtctatttggaccaaaattaggaagttttgaacaagagagcatggttagcaatctttatcaagctcagacccaactaaatacaacacgatctgctgctgaaaacgctaaagctactagttttgaaattcaaaaaggagttatcatctttggcgattctgttactgttcgcgctagttctgccatacagaccgcgctaccagatgcacagatcgatggaactgtcagtcgaaatctctctgaaattgctaaattgataaatctttataagcaaaataatagcttgaaagagactgtagttgtagcgctaggtacaaatactacggataattatcaggaactactagaccaactagtcaaagattttcctaaaggacgtcgccttatttttgtcactccttacgatggaaacttcactccgagcgaatccatttcttatcaaactggtcaatacgagaaagaattggctgaaaaatatgattatatttccattgcagactggtatcaagttgcaaaggataatccaccaatttggtacaataccgaccttgttcatttcaatcttgaaagcaatggaggcgaagtcttcgcccaaacgataaaaaatgctgttgaagccgttgctgatggtccaatcaaaaactagatttatacatcatcatcctctgagaatttctcggaggatttttgcacgattttccgataagtccagtgcgaactctaagaaatggcgctgtgcctgagctcagtctcaataaatcttgtgaaataagccacttctacaaaggacggaaaagcgaagtaacgataatagaaagatgacaagttaaaaaaactcctaccttttacagtaggagttggtgtcaaattgactatttttgcttactttggaaacgccattcaaagcgtttctgatcgtaaaatggatacatcatttgtaaaagagtgacggcaagtagccaaccaccgataatatctgtcgggtagtgaaccccaatatagatacgggatacagctaccaggacagcaagtagaatcaacatggcttgtagcacaagtctagctatgcctttcttcatcctctggtgaacaataataacaactgctcctccaatcatcatagttgatgcagtatgccagctaggaaatgaataaccgatggtatcaatcaaccattcaatacttggacgcggacgttggtagacatatttcagggctgtggatgccacacccatcgccgcaaaactagcaagtaggaaataagcttctatcttccattttttatagtagtaaaagatagcagctagaatcatggtaatagctaaaataataacagtatttcctaaaacagtaatagaggtccaaaattgactggctccacttggtaaatttccacgaatggcagactggacagtcgaatcaaaacctgctagggtactaggataaaattttactacatagcccaatgtcacaaaggccagagcaaaaaaagatgcgtttcgtaaatggatttgtttattcttcatacagtatagtttaccttataaaggttaaactttctttaaaataggttgggctgctttgtaacagatataaaatattgccgaaagcacaatcccttgtaaaagattaaaaggaagtaccatcataaaaagatagttagtcagacccaagatttctttaatatcaaaatttgcaaaagcagcataaacaggcaccgcataaacgtaatttaatgccagcatcactgctgtcgaaccaattgtcgcaacagcggctgcttttaaataattttttaacgtttgttcatttttccagaaataagctactgctaaaatgaaaactgacatagctgcaatattcatcggtaagccaataattgtcgatggtccctgattatttaaaatcagtttgagaaaagttcgtaccaaaaggatagcaaaactagacttcatatctagaataagcagaccaaataaaatcggtacgagagaaaaatccacttccaggaaactggctgttggaatcagtggaaatttcaaatacatgagcagaaaggatactgctgagagaatggcgataatcgtcattttgcgtgtgtttgtcataaggttcctccaattttgaaaattgaagaagcgtggaagagcaggcaaaaggcctccacttcgtcttctcccatccagactttactgtcggttgtggaattgcaccacatcagctttcgctcgcagactaccaacggtctattttgttctaaaactgcgttagctcatctcgacatacattcagtatggtcttcgattcgctgcctagtcgtaaaacaaattaccacgttttacactgccggtcgggaatttcaccctgccctgaagactatttcatcataccaaaaaagccttgcatttgcaagagcttggtaagttttcactattttaacttgtccccatcataggtgtgaaccaaatctagaccagcgaactgttgctgccgaagagcctcatatacaatcatacacgctgtattagagacattaagactacgcacatgttcatcattcattggaatacggatagccttctctggatgttcacgcataaaatcttctggcaagcccttatcttcacgaccaaataagaaataatgaatgttcccatcattatagtcttcatccgaataggttttatcagcaaatttagatactaagtgaacacgtccttgtttgctggcataatccatgaattctgctaaattgtcatagaagcgaacatctaacttatcccaataatctagtcctgcacgtttcatcttacggtcatcaattggaaatcccataggcttaatgatatggagaggactattggttgcagcacaagttcgagcaatattgcctgtattctgtggaatctgtggttcaaataagacaatgtggtttttggctgtttcttctatatactctaatgtttcaatattcataagaacctctctggtgacatttcactaaacacgaatacccttcgaaaatcaaatccaaaccattgtcagcttcattttgccgtataccagtacggtctgttgcttgttgtctagtttctttttttgattttcattgagtaaaaagactcgactgtctcctatggcaagaaagacaaaaaaatagccacactgcccggagtcaagctcagcaaacagcatggtgaatgatgattcattcacttaactcacaacaggtttgagttaaatcaatgaaatcgtgatactattgtagcttaaagaaggctgaaaatcaagagttttgccccatttttttcaaattttcatagaaaatcatggaggctgggcagaaagaccaaccttgcttctcagagttcgtgtcaacatctgagcgcagtgattgattggcttttacagtccagtggactgttaatattgaggcgaacttgcttcgccctatctccagccttaaaaggctcccaaatcttttgagagagtactaaaggcaacctaaaaacctatatttatacagaacaaaaagtaggttgccctacttctgcttatttcttttcaaactaaacctgtccggcacaggatcttctccaccttccaccaagggatgacagcgaccaattcgagccaaccccatcaaaaagcctttgagtccatgtttttgtaaggcctcgatcatataagccgaacaagttggacggtagcgacaagagggcggaaaaaggggagaaataaatttctgatagaatcggaccaagccgatcaaaagtctagtcattattttttaactggcttagtaacggccagggtatgtagtttactgatgtctttcttattgagcttgcggtattctcctggacgtaggccggtcaagtcaagattaccaaagcgagtacgagacagcttgtctacctgcaagccgacagcctcaaacatcttcttaacctggtggtttcgaccttcatggattgttaattctacaactgagcggttcttaacagggtccacctttataatctcatacaccgcaggcttagtctttttgccatcaatgacaacaccacgggtcaagggacgcaaaacttccttgttggcaacccctttgacacgcgccaagtaaaccttatcaatctcattacgtgggtgaatcatttcgtctgtaaaatcaccgtcattggtcaaaatcaagaccccagatgtatcccagtccagacgtccaactggataaatccgttccttaactgttggcaacaagtccacaactgtctttcttcccttgtcgtctgacacactagaaataacacctcgtggtttattgaggagatagtagaccttctcttcgttataaattggttgtccctcaacctctaccttatcacccgatttgataactgtccctagctcacgaacaacctgaccatttacagtaactagtccttgtttgattagttcttctgccttacgacgactggcaactccagcatgggcaatgtatttattaattctcattttctaactcatttctttctacgaatagctctgtttcctcttgaatcaaatctatttcagacacatcaggcaattcttctagactattaattcccatgtaatccaggaaataatccgttgtcacatagagatttggtctaccaagaacctctttcttaccgttctcacgaatgaggtcaaaggcctgtaatttactgatggcaccactggaattgactccgcgaatatcatcaacttcaatccgagtaatgggttgcttataggctacgattgataaggtttccaaaagagcccgtgacatagtctgattgattggtgttttggcatagattcgcaaaaggtttgcatattcttttttagtaaccaacttgtagcgattggaagactccaagatggctaagcctgaggctttgtctgccatatatttctcactaagtttctctaactgctggctgacagctgtcggctgcatttccaacatctctgccaaatttcgtaacgtcaagccatcctcacctgccacaaagagcaggacttcgatttcagctaagcgattcatcttcactccttactagataaatatctccaaaagtctctgtctgctccaggacgatttcatgaaccttgaccaattccaaagtcgcaaggaagatcgtaatcatttcattgacatcttgactttcttgaaaaagctgacggagttcaaggcgtggaccagtctcgaaacgactgcgaacaaagtccatcatgtcttcgattttatattcatcacgggcaatggtcgcatgagactgacggaggcttgcctgtttttcagccattactttagaaaaagctaggaaaatgtcaatgacggtcttatccttggctaactgtacatcatcataaatcaaatctaatttgggttttgaaaaatagttggcccgttcatcatgttgctcccctaatttctcactgagaagtttgaacttgcggtattcttccaactggtccaagaggtccatttcaggatcatcttcgggatcaatttgctcaacaaccttcggcaataaccgacgacttttgatgaccatcaattgactagccatgagcatatattctcccgctacctctaaacgcatggcttgcaaggtagcaatgtaggccaaatattgctcaataacctctgtaatcggaacctcgtaaatatctacttgatacttggacaccaggtgtagcaggagatcaagtggcccttcaaaatcttttaattttatatccattatctaaatttttccaaactcatgcttgttttcagtcccaactgcttggcgatttggtccaaggattttccttcgtctatctgttttagaatatactgctctcgcaatttttgggctgtccaatcaggcttgccgatggactggacaaattctgtcagacgattaaaaaaccattgacgagaataggtctgtcccttcttatcgaagacatagcgtccagacagatgagactccatatagggtatcaattccttgggcagagtgagcacccgcttggctcctcccttctcaactgtcaggacttgaaaatccagattgacctgctgactagtcagctctgctatttcacttggcgtcaaacctaaatatgctatcaaaagtgcgatgagctgaccttctagccaaggactttcttgaaagaggagagttaaatcctcacgctccagtttctttttgacgctggctggacctgacgtcgtttgcaatttataaaaacgatccaggagattattttcataaagaaagtagagaaattgattgaccgctgacatttttcttttctgagcagcaggtttcaagtctagaagagactgctgatagaccaaaagagactgttggctaatctccccctttgttactgtcacaaactgctgcaggtcataggtataggacttttggctgttgacactgacctttttgctctggataaaagattcaatcgcctgcttcatttcttgccttcttttgatgctagggggaaattatgcaagagagcattgattgcctttaagatggattttcgtgtaatgattcccataaattctctattttccccaaggacgggtaagaaagattgatctactagcttacgcatcacctctgtcaaatcataatccagaccaaccgtctcttcatctgtctttacaatcacagaaatatctctgtttaactcatcatccgatagttcattttcagcttgatatttaatgatttccgtcaagccgatggttccaaaaaagcggccatcttctgttaccacaggtacgcgtgaataggtcatgtgactgagtaacagttttgcatggtcaatattatgcgtatcaataattactgccaatttatccgctggtgtcaagaaagtttcttcctggtccaataaaaaggcttcaaattctcttgcaatcatcttgaaatatcctttgtcaatgctgggtaaagttggtgctgtcgattgtagtaatccacatggaagtgatcatcatagatggtcacaagagcatagagacattctctgaccaaaccacgaggttgactaacggagccaggattgaggaagagggtcttgccacgcacttcggcatcaggcacatgcagatgcccatacaaacaaatatccgcatcaacttcctgggcccaataatccaaccgctgccagccgtaattaatgccataaagatgaccatgagtctgagcgatagtcacaccatccaattgagtaatgagctggtcagggtaaccaccaaaatagtcgcagttcccattgaccacttgaatgccgtcccacaaactatcttgactatccagctccgaatcaccattgtgaaagatggcatcgaccttgccaagataatgatgtttaatatcctctacaatctgtctatccccatgagagtcgctcatgactaggattgttttgcttgctcctgccatactggaaatgcctccactaatttttctagtgcttgtgcacggtgggaaatcttatttttttcttctagggttaattctgccgaggtcttacctgtttcgcctacgaggaaaagtggatcatatccaaatccattttccccacggaggtccataccgataaagccttcccagtccgcttcgacaaccaaactatcacgatttggagcagccatgaccagagtacaatggaattgtgccgaacgatctttcagttcaaataccatggccaattcgtgcaagagcttggcattattgagctcatctgtggcatctggacctgaaaaacgggcagaccaaactcctggcaggccacctaaagcatcaaccttcaaaccagaatcatctgccaagaccatcttgcctgtcagctctgctatggtttcagccttgagccgtgcattttcctcaaaagtcatacctgtttctgctacatctggcaggtcaggatagttgttgaggttctcgacctggtagccaaaacgctcaaaaaacttacggaattccttagtcttaccttcattttttgtggcaatcaagatggtatctcccacgcttgccaatcccttgtcttgaccgaagaaatctgccgtgctaacccctgcttgtggcagatgaaccaagagaagtttgtcattctcagttaccagaatagctccttggtgttggagggccttgaactgacgattgtttaactcattcaaagtatcacaggcaaattgaaagagggcaaattcagactgaagtttgatcacttcaatgttgacacactggttaaagttctcatcttcataattaccagcaattagtttgtcaaacaattgaccaatctggtaaatttcctgctctctgccattttcaccaaatgaaccaaatagattggcaaagctggcttttccaataaaccaattgtgttcatctctgtattcgtatatcttgtctgtcatagttctacatgctccacatgaatatcaatgcccatccagctttcagctatttctttaaaagctgccggactagctgttgtgtaaaatctgtgctgaatatccttttcggtacggctgcggttgatttgaaaataatttaataaaacagaaatatctcgcgcacattctgccccactgtcaatcaacttgacatccttgcccatggcattctggatgatagggcgaagcagaggataatgggtacatcccaagaccaaggtatctacttgcccaacaagtggtcgaagtgtctcataaacaacctttttggccaaactggattggtggctattggactcaaccagtggtgcaaatttgggacaggctaggctgtctacctgcgtttctggagaaagggcctgaattttttcacgatagatatcggattgaatggtcatagccgttcctaagacaccaaccttaccagtttgcgttgccttaatagctgccgaagcacctggtaaaataacacccaaaacaggaatatccaacttttccttgacttcttcccagactaccgctgttgccgtattgcaggcaaagacaatcatttttacattttttgtcaaaaggaaattgaccaactgccaagtatattctctgatttgttctgctggacggggtccataaggtgcccgtgccgaatctccgatataaacgatttcttcatggggtagttggcgcattaactcacgcgcaaccgttaatcccccaacacctgaatctaaaaaacctattggtcgattatccataatactgagaatagccagaaaatctgactagcctttcttttctactcaaaaaatgggatctgggaatgaatatcccagtcccagtttgattattttttcttgcttgccactttttgttggctcttgatttggcgaagtacttgttgtacttttgcctcgcttggtttttgccccatttggctcatcatcaaacgcaaagcattctcatccaaaattggtttatcagcaatgtagttttctacctgtctgcgtgacaagtaaatacccaaggccacaccacctgcaaatgccaatacaataagtaaaatagctaaacctaagttcatctgtcaatctcctgactcttctaaaaagtatacttctgattgtttttaacaatctttcaataaccctattataccaaattccctagtcttttccaagacttacctgtcaaaatcaaaaccgtaaatagttgcgaaatagtcttctggtgtttcagcacgacgaatcatccgcgctgtgccatcttcctgcaaaaggatttcagaagaacgcagacgaccgttgtagttgtagcccatggagaagccgtgggccccactgtcatgaatgaccaaggtgtctcctacttctacccgtggtaattcacgattgaccgcaaacttgtcgttgttttcacaaagggaaccagccacatccaccacttcgattggcgcatctgggcgcgtgatattggtgatatggtggtaggcgccatagaaggcaggacgcatgaggttggctgccgatgcatcgacaccaatataagtccgataggtttccttacgatggagcacctttgtaatcaagtgaccgtgtggcgccaacataaagcgacccaattctgtaaagattttaacatgtcccataccagctggtgtgagaatttcctcgtaaaccttacgaactccctcaccaatgacagcaatgtcgtttggttcttgctcaggacggtagttgactccaatcccacctgataggttgatgaagtccaaggtcacacctgtttcctcacgaatttccaaggccaattcaaagagttgacgagctaagacagggtagtagtcatttgttactgtattcgaagctagaaaggcatgaataccaaactgcttcacacctagttcttttaattccttgtagcccttcatgagctggtccttggtcatgccaaacttagactcttctgggtggtccataatatccgttcccagcgagaagaccccacctggattgtaacggaggcagaccgtttctgggataccagcaacatttttcaaaaactcaatatgctcataggcatcaaggttaatggtcgccccaacttttctggcataaacaaactcttgcgcttgggtgtcattagatgtgaacatgatgtctttaaagcccaatttttcactcatcagcacttctacatccgttgcacagtccactccacaaccttcttcttgcaagatttttaaaattgctggtgtcggtgtcgctttgaccgcaaaatattctttaaagcctttgttccatgaaaaagctgcattaagggcacgggccttctcacgaatgcctttttcatcatacaaatgaaaaggagtcggaaattgctccgtaatgttttctaaaacttctttactaacaaatggtgtcttggtcatgtcactacctcatcaaatatttttcctattatatcacaaatatgtgaggaactgtagctttcaactccaccaaatacttgcaaaataaattatgagcgctataatgtgattatcattaaaaaaggagtaatatatgtcaacattagattttgattttacagaacgcttatatgccaactatctagctaatccaagcctacaggcaaccgaaaatgccgttagccacaacggacttttgaaatccttagaaacacgccaaagcgccatcgacaatgactatgtcttttcaatcgacttgaccaaggacgctgtttcaaaccaaaaggcttctggacgttgctggatgtttgctgcattaaacaccttccgccataaactcatctctgacttcaaactggaaaattttgagctatcacaggcccataccttcttttgggataaatatgaaaagtccaactggttcctcgaacaaatcattgctacagctgaccaagaaattggtagccgtaaggtaaaattcttattggatacccctcaacaagatggcggtcaatgggatatggttgtggccttatttgaaaaatatggtgtggtaccaaaatccgtctatccagaatctatctcatccagtgccagccgtgagctcaatcagtaccttaacaaattgctccgtcaagatgcacaaatcttgcgagacctccttgcaaaaggagcttctccggaagaggttcaaacacaaaaagaaaacttgcttcaagaaatctttaacttcctagccgtcaaccttggcctccctccacgtagctttgattttgcatatagagataaagacaatgtctatcaccgcgatacaaatgtgacacctcaggcattctacgagaaatacgttggtttgaaactatctgactatgtctccattatcaatgctcctacaactgacaaaccctacaataaatcttatacagtcgaattattggggaacgtcgttggtgcccctgctgtccgctacctcaatgtagaaatgaaccgttttaaagaactagctattgcccaactcaaagctggtgagtccgtttggtttggttccgatgtcggtcaaagcagcaatcgccaaacaggtatcatggcaaccaacacctacgacttctcttcaggtctgggtatccatttccatcaagacaaggctggaagattagactactccgaaagcttgatgacccacgccatggtcttaactggtgttgatttagatgacaatgagcaacctctcaaatggaaagtagaaaactcttggggtgacaaggttggtgacaagggatacttcgtcgcatcagatagctggatggacgagtacacttatcagattgttgtccgaaaagaattcctcacacaagaagaactagcagcttatcaagctcaaccacaagtccttgccccatgggatccaatgggagctctagcataacaaacgacatataaaaaagaggtaaatcctcttttttatatgtcataattagtctctactcaaaccaccaaagatacggagtaggttgaggaagaggttgatgaagtcaagatagagctgaagcgccatggatacgacccacccttggccaacattaccaccagtttgttcgaaaacattgcggatacgttggttgtcataagcaatcaaacctgagaataccaaaacagaaatgatagacatcataaagcttagaccagagctacgaaggaagatattaataacacttgcaataataattccccatagagctgcacgcaatgcctgagccataccagaaagatccttcttcgttgtcatcccaattacagccatgatagcaaacataagagccgctgacacaaaggcaagcacaactgtttcactagtatagaacatcaaaatcatgctaatggtgataccatttgttactgagtaggcaagaaacattggtagagccattgggctatttttagctgccattgctgaagcagaaacaaccaaggcaatctgaccaatcataatcagcatcatgatgatggaacctgcactcagcagactaagcaataaagattgaaagacggtcacagccaagaaagaaactagagctgacagaccaattcccatggcaaccacaccataaattttaccgaagaaacggttgagggcggtattatccacctgattaataataaatgaatcgttattcatactattctcctttaaatcatcttattgaaaccgaaagaccttacgatttttccacttgtgttgtaagggcagactccactctctcacagcccaatacttatccacgcatgtcacaatccaggattccttgtagcaaggaggagcgattgtcgcaccaaacatatgcttcacaatgatgtcttcttctagtttattgagttgaatgagtttctgagcattgcgtttagcaattcgtggatgaacccaagcatggctcttgttgaatttggtatctctccagtcatagaagaataaatcatgcaatagaccaccacgagctgttgacttggcatcccaaccaaattttttcgcaatcttataacttgtataagagacattgatggaatgttccaagcgcgtggagtgataatgatgaggaattttccccaatttttgcaccttgggtgtggcaatcaagtgccccacgtaatgcatgtattctttatcttgtttatatgcaaccattcgttaacctcgttggaatattataccacactatagtacaattggcttaaataaagctaaacaatagaatacccgccgcaattgctacattgaggctttccgcctgccctggcatggtgatatgaacaagttgatccgcctcatcagccactaaatcagaaattccctgaccttcgtttcccatgaccaaggcaaaactagaatgtggcgtaatttccttatagtcaaccgactgactagagagggtcgttgccaatatttgtatctgattgcttttaagagctgtaagaatggaggaaattggcatccgataaactggcaaatggaagtgactcccctgcatggaacgaagcactttcatattataaatatcagccgacttatccgatagaaatactccatcaaaaccagctgcatcagctgtacgaatcattgtcccaacatttccagggtcctgcacatcttcaagaaccaaaaattttccatccaaagtctcaggtaaacgttggctcggcaaagcaagttgagctactaccccctgaggcgtcttagaatcagctaattcttgcataatttcaggactgacaactgtcacattggctaaacctgcaaccttttcaaaatactcttccaccacaaaaatatgctcaatattggctccagcctccatcgcttcctccagcaaatgccagccttcaatcaaataagaagaagtacggtattttttctgttgtaatttcttaacctgcttgaccaaatgattggcctttgagcgaatgatctccatgaatgccccttttcttttactgctcagcaacttcaattttccaacggctaaatcaattatcttgatttttgaacagtcttacccaaccatgatataataaagtaaatgtcttgtcaaaaggagaaacttatgcgaaaggtaaaaatgattgcatctggtcgtgtgcaaggagtcggctttcgttggtctgttcaatttttagctgtggaaataggcgacatctacggcagagtttggaataatgatgatgggactgtcaccattttagctcagtcagataatgctgagaagctcagccattttatccatgaaattcggaaagggccttctcgtatggccaaagtcatctatctagatgtcaccctagccaattttgaggactataaggattttcaggttagctatagataaaacttgtatatttccgtcaaaaaaagtaaaatagagagtatactgaaaaaaacaaaggaacgaaaaaaattgaaaaataaacgtctactcatcttgtcaggcatggccttatcaactcttcttttcttatctggttgtgttcaaactgataaaagcggaaatcctacaggtcccatttgggattggttgggacaaccaatgtccaacttgattcgcttttttgcagaagatcaagctctaggatttggtcttgctattatcatcgtcaccttattggttcgattcatcatcctcccattgggaatttaccaatcttggaaagctgctatccaatctgagaagatgaattatctcaaaccgattttaggcccaatccaggagcgcatgaaaaatgcaagctctcaagaagagcaacttgctgcgcaacaagagtattttgcaactcaaaaacaatacggtgtgagcatgctcggcggaatcggttgtttgccgatgctgattcaaatgccattcttctctgcaatctactttgcggctcgccacacaccaggaatttcagaagctactttccttggtattaatttaggttcaactagcctgattttgacagtcgttgctggtattttatactatgcccaatcgctcttaatgcaagtcggcatggatgaagaacagaaaaaacaaatgaaaaccatggctctgatgaatccaattatgatcatgatgttctcatttgggtctcctgctggagtgactctctactgggttgtcggtggtctcttcggtattcttcaacaagctattacaaacttcattttgaaacctcgtattcgtaaacaagtggaagaggaattcaaaaatatcacagtgtcagcaactcctcgtaaaacgaaggacgttactccaactgcttcagcagttattgaagaaaagacatctaacaagaagagaaaccgtaacgccggtaaacaacgttctagataaaaaatcgcaaccatctatttcagatggttgttttcttatatagacactatgtaaagatccccagttgagaattcgtggatttacctgtacactagaataaaaaaataatcaacttctaacaggaattaccacactcaattagaggtctttacatattgtctatacaaaaagagagaatctttcgactctctccacaccttatttcgttttttcaaccttcaagatttttacatcatagctaccagcaggtgtttcaattgttgcaacatctcctgtttttttaccaatcaaagcatggccaattgggctttcgtttgaaatcttgtttgcaaagacatctgcacctgcagcaccaacgatatgatagacttcttcctcggtctcaccaacttcttgaacagtcacagtcttaccaattgctacttcatccgcagcaactgcatcactgtttacgatttcagcatagcgaatttttgtttcgattgttgagatttgaccttcaacaaaagcctgttcatctttagctgcttcgtactcagagttttctgaaaggtctccgtaagaacgagcaattttaatacgttcaacaatttctggtcgacgaactagctttagttcctctagttctttttctaatttttccttttcttccaaggtcattggatatgttttttctgccatttgtctttccttttcttttatttttcatgaaaacaaaattatgtggaaaaccacataattttgttttaagaatttactcattattaagatgtgcatttacatacttagcaacgttttggttatgttcatcaatattatttgtaaagtaaacatttccagttgtaacatctgctacaaagtaaagatagtctgttgtgttggcattaatcactgcctcgatagccgaaaggcttggactatccactggtccaggcatcaatcctggggtccaataaatgttgtatggtgactcaattgatgtatcaatcgctgcatcttctgctagagttgtttcttgaccaagtttaccctgagcatacaagattgcaatattagattgtagaggcattgctgcattcaagcggttaaagaagacacttgcaatgtttcgacgatcttcatcagtagaaccttctttttcaaccaaagatgccaaggtaagaacttcatttacagtcaaattcttagcagtaatcgtttcataatatggttgtaaacgattatccatcgcggcaatcatttgctcaacgagctcttcgatagttgtttcatcgctgtattcataaaccgctgggaagaggtaaccttccaactgataaataactccactatcagcagctggtaagctggcaaacaattttggataagtagcaaccattcgattaataaaatcttggttggtcacagtagccataaactgttctgcagtaaatggtgttttatcgttcttatcttttgtattagtattgtctgtaatagcctgagcaatttgtgttaatgtatacccttcaacaatcaaaaccttccctgcagcttctttttgagctgtcggagttccgctttcttgaagtgctttggcgatgtcatccacagacatattttgttttaaattataaaaaccactttggaaattattataactcttaattttagagtagtaattaaaaatagtagcattcttaatcaacttgttgtcaactaaaattttaccaatttctaaagttgaagatccttctggaatctctacctgaatagtttctgtagcttttgcattaactggttccagactagattttacccacatatagccagtaacacctgtcactaggactgccactacaacaatcgacatgataacagagacaatgtgtttagcggcattatcttgttttttacgacgttgcttgcttgttctgtgggttgttcttcttctgggttgtgtttcctgcatctgcttgtctacttctggaacaatagccgttgtctttggagcaataatagtttcctctagtgcgatgatttctgtatcacccgttacagctgatacatcttccgttggaaattccaaaaatgtatcttccaaagaagacttctctgaaaggacagactctactggctcagaaactgacgagcttgatggtacttcatcaaatcctgccgtattagcagccacaagattccttaatttctccaagtttcgttcaacagtatcttgtggaactggacttgaaacaacttctttttcaatcacaaaagtctctggagtagccaaagtttctgatgttggctcttcaatactttccgtcatcacttctgattcttgctgttcttctgacaagtatgaatcagggaaagcaataccttctacttttacaatttcagtctctctatggggggctttttcttcggcaagactaggctggagctcattgataacttcattacgcttatcaacaagaacatccgctgactgttccgccaaacgtttcaccttcaattcttccaaatctcgtaaaatttgatcgcggaagcctgaagactgcgtgtttttttcattcgtatcctttgtcacgctgttactcctttcacacagttactatacattatatcttaaaggcttatgaattgcaagaacttccctttctacaaggctttccagtacatatcactccacctttgtcctccaaattgcgacaaggaggggccaaaatcttcaaactggttcatttcatagtagctaatcaaatacctcttacaggtcagggaaactccttcaaatcctcccgctaaagccacttcttttatggctgccaacaaaagagttcccactccctgtcccttataggcatccgctacggatagactggcaatagctaggtgaccgcctgtcggcatgtcactctctgtcaagtaaaaaatatcgtctgtaacagtctgcgaaacagagggacaggataataaatatcctgctatttcctcatcgtgttccattattaaacaggttttactcaaagtattcagataagtagcaagaacagactcagctatccgttcctctttagaaaaattggcattttcaatcaaaacaacctgttctaaatccgaaggagtagcaaaacgaatttccataattttctcccttatatagcggaaaaacaggggccataggcctccgtctttctttttattggacgttatttgtaagatttgacaagagtctttcgaaggaatattcataggactgaatatcaccagctcccataaatacatatacggcattgtcatggtctaaaagtggtgaagtgttttcaactgtaacaagtccaccttttttgttgattttagccgccaaatcttctaccttaacctgaccattgtctgtttcacgcgctgatccataaatttgagcaaggtaaactgcatctgctccattcaaagcatctgcaaactcatcgagaagcgcaatggtacgagtgaatgtatgtggttggaagatggctaccaactccttgctaggatacttctgacgtgccgcatcaatggttgcaatgatttccgttggatggtgagcaaagtcatcaatgataacagtatcattgacaattttctccgtaaagcgacgtttgacacctccaaatgtcttcaagtgttctgcaaccagttgcaaatcaaatccagcaatatagagattggcaataacagctgttgcattcatcacattatgcttaccaaaggttggaatttggaattctcccaactcttcttcaccatggcgaactttgaattgtgaaccacttgtagaaggcttcaagtcataggcaacaaaatcattattgtcttccaagccataatagtagattggagcatttgccgtgatacgacgaagttgctcatcttcaccaaaaacgaagagagcattttttacttgcttcgcataatcattgaaagcattgaaaacatcctctagactagtgaaataatctggatggtcaaaatcaatattggtaatgatgctgtattcaggatggtatggggcaaagtgacgttcgtattcatcggattcgaacacaaaatactgagcatttgccgaaccgcgaccagtaccatcaccaatcaagaaggaagtatctgtgatattgcgcataacatgtgccaataatcccgttgtagaggtcttaccatgggcaccagcaacaccgaggctcgtaaaacctttcataaattcacctaaaaattcatggtaacgtttgtaggtatagccctgggcatcagcataagcgatttccacattgttatctggacgaaaagcattaccagcaatcaattcaacatctgctgtaatatttttctcatcaaacggtaaaatctgaatcccagcttgttcaagcccgcgttgtgtaaagtagtatttctctacatcactaccttgaaccttatgccccatttgatgcaacataagagcaagtgcgctcatacccgatcccttaattccgataaaatgataggtttttgtcatgttattcctcttctatatgtgtcaaattcaattcttgtgccacttggcgatctcgttgttgtctgcgctcaggataattgtaaacctgactctttcttaaaaagtcatacgaatttttctttataacctgctcctgttctctatcttctttcttcaaagaatagacagctggcatatcagcgagaatatagtctgtctgacgtaggttgtccgccaaacgtgtcaaccgacctgccttagattcagctgttgaaacgacaggaggtttcaccacaactttagctggtgctggtttttcatctcttaagtaggttgctgatcgttttttcttcaagtcttctctagcctgttcacgagccaactgcccctgtgttttcactggagaaggcttcgttttagtcagttgctgaaggcgttccttgcgagaataatggcttggcttagcttcaaacagaggaggcaggagctcatcttccgtttgtgctactggttttgccgacgcaactcgctgtgaatcggtagaccagctaaattccttttcttgataaggtcccctgatattgctaatcaggtcgctctcatcatataaactcataattggattttctccaactagtacctcatcatctgcgactagtggaaatcttttttcatgtctaatcataagtcatcctttcgaacccttattataccatacttaggccttatttcctaattctacgctgagtcaactgattccatatcactcaatccctaaaatctcacgaatatcctcaaccgtcaaattcgctcggctttcattgccatcaagaactgttttaacaaggttctttttattttcttgtaattcttgaatcttctcttcgattgtccctctagtaatcaggcgatagcattcaaccttttcagtctgccccatgcgatgagctcgactgatagcctgagcttccacggcaggattccaccaaaggtcgactaggatgactgtgtctgcccctgtcaaattcaagccaacgccacctgctttcaaggaaatgagaaaggcatctcgacttcctgcattgaaggcctgtgtcatttcttggcgttggttagcaggggttgaaccagtcagagtataggaagtcatcccaatttctatcagctgttcttctattttttccagcatatttctgaattgggaaaatatcaagaccctgtgttcaccttcttttagttgcaagagtaattctttcaaactattaagtttgccactctcaccactaaactcttccatgaaaaggctgggagtatcgcagatttgacgtaagcgagtaattcctgataggatttctatcttgctacgattgatttgagcatcatctgcgccagctatttgagtccgcatttgttgaagctgggctaggtagatagctttttgttcatctgtcagttcattaagtacattgacctctatcaaatcaggcaattcctgaagaacgtcttccttatgacgtctgagaacgaagggttgaatggtccgcgcaatgtccttggctgctaatttaccgaagtcttgtttgcctggcaataaacctggtaagacaatttggaaaatggaccatagttccgtcaaatggttttcaatcggcgtacctgagagggcaaagcaattcccaacctcaaactcacgcagaagctgtgcaatcttagattgggcattcttcatgacctgcgcctcatctaaaatgaggtagtcaaagcgttcctgtctatagagtgcaacatcctgtctgaaggatggataggaggtaactaagacttggtgatcattggcaatgatctcttcacgctgttccttgtttccatggacaacagccacatctaaacttggagcaaaccgcttacactcatctaaccagttataaatcaagctagacggtgccaatattaaaactttggaatcttttgtcatccgactggacagaaaggcgatagtttgcaaggtctttccaagccccatgtcgtcagctaaaattccgccaaaaccatacgtatccagcatagtcaaccacttaagccctgtctgctgataatccctaagcgacgttgttacttccacagcaggaagcgggaacaaatctggctgagctagatagcttgccatttcctcaaattccttggagaaactgacttggttgaattgtgacaaggattgagccaattggtaaccggcaagagcatggacttgtacctgcccctccttaccatgacgggcccgcaaatagattagggtttgactgattttcttggtttcctcatcaaaaacaaataccttaccgctcgggctagtatagtgatcctcttgattcaacaaggctgtaatcgcctgatcgatttcagattgttcaatacctgataagtcaaacgaaatatccaaaagtgagccgttacgcacaatttctaattgaggtttggcttcaatatataaagcctgtagcctttctgctagatgaacctgccccattttttgtaatataggcaattgttgttggaaaaatggatagagctcctgctgactaagagccgctctctgggcatgatatgtccccctaaagccagctaaacgaatagcctgatagaccctctccaaatgttggaaatggctggcaaaaggcaggagagccaaatcctcttcactccttaccttacgtccatcaaaatccaaaaccaattggagtgataaactgtcatttgcctccatctgaatatgaaattctggcttgaaatcatgaatgatgaagcgtttaggtgccttaacagtcccaattgtctgcaaatccagcaagcttaaagccagacgattttggtcagggaaatctacctgcacttttctcaaacctgattcggttggaacaagttcggaaatttggtaaatcagatgttcttgatggcgattgacactataaaccgtgccatttactaagagatagcgcccatgaaaaagtggtcggactgttttttcgtgaataaccatttcaatcatctgcgtgtgaacggtcacctcaaaatgatagagcccttcctcacctgtcaacggaagaaccatcaaggaggaataggactgctgttgataggaaaagttaaaatgttctagctgatttaacagctccaacccctcctcaaaataggcttgtggcagacgaaaatgtcgtccaaaatgagtaagaatatccgaatctataccaactttctctggtaccaaggcccagagaaaatccaggagagcctgacttggttcatcaaaattttcataagtaacttgctcataataatttttacctatctgatagtgaccgttggctttcacaatgcgcaaaaaagctccgatgtcccgcacaatgtacgaacgtgtatctggcaagcgggtaattttcaaggtccaatctatctgacgatcatagggcaataagctcccttcaactgataactgatacttaatccccagttcaggttctggccgcaaaatttcatctaaaaagagaccgccaaaataagtccgacggacggtttccttatgttgttcaccatcttctttcaaagactgcttcatatccttgcctgaggcatcattttttaaaaaatactccgtggcagctagatgttgacagtaacctttactttgaaataactggcaactacactgtaaatcgctatctgcatcgccgtaagtaaagcgctcaccagcaatatccagcaccatctttccattctcactatgaagaacagtcagttttccagcctcgtacaaatcaattccttcttggcgaatccgccctggcatcatgcgacccattctaactcctttatccttcaaccaatcatcagctcttctgtaaaatatatctaaaatattatcttttcattatagcatattttcaatttgaattgtttaaataggtatcaaaaaacaccagcaggtaaactggtgtctctaatgaatagctaaataataaatcgttgcttgccacattttcaagattgtttttccgaatttccaaagccaaaatagggcaaatagcaggaaaacaactgccactactacgttaatcaagccttttccaaccaagaaaaacttgaaaaagaagacagtcacacaagtaagcaaggcaaggagtaaaacatgaatcagaactcccaaccagcccagccaatagcgaattccaaagggagggtgtttcttttcatcgaagtctgctagaccagtcaaaaactcaactagcaactcacccaaaaattccatactagcctacctttcttacctgtcgataatatttggttcgtcgaatcatcatcttgatagccttaaaggaaagtaaggttagcatactagccacgaatagacaaaaaaggaatatcacaaccaatggctgtttatactgattatagaccataattgaaccaccagtaaaggcgataaaataggatgccaaagtcaccaaattgagccagatacaagccactagccccagccaataacgaaagccgaaaggtttatactgactgtcttcataaaatacaagaaaaaatgatgaaaaagaaagcaatatcaaaaaagaacgccaaatcggaaccgctaccataccaacacctccaagtccattctagcatatttacgaataggtgcaaagaaaaaagaggttgccctctttatttccgtttccgtgcaatcagatgaatcggtgtcccttcaaatacaaaggccttgcggatttgattttccaagaaacgcatataggagaagtgcatgagctcttcttcgttgacaaagaccacaaaggtcggtggtttggtcgcaacctgagtcgcatagaaaatcttgaggcgtttgcccttgtcggtcggtgttgggttgatggcaatggcgtccatgataacatcgttgagaacagccgacggaatacgggtattctggctctcactgatggccttaatcatctcaggcaacttatgcaagcgttgtttggtcaaggctgacacaaagataatcggtgcgtaagacaagtattggaactggtcacgaatatcgtcttcccactgcttcatggtatggttgtctttttcaagcgtatcccacttgttgactacgataatcattcccttaccagcttcatgggcaaagcctgcgatgcgtttgtcatactcacggataccttcttcggcattgataaccatcaatatgacatccgagcgttcaatggcacgcatggcacgcataacagagtatttctcggtattttcatagaccttaccagacttgcgcatccctgcggtatcaatcatggtaaattcttgaccttctgggtctgtaaagtgcgtatcaatagcatcacgagtcgttccagcaacaggcgacgcaatcacgcgctcttcacccaaaatagcgttaatcaaacttgatttaccaacgtttggacgaccaatcaagctgaacttgataatatctggattttcttctgcttcctgagctggtaggttttcaatgatagcgtccaagacatcccctgttccgataccgtgtacagaagatactggataaggatcgccaagaccgagtgaatagaaatcgtagatgtcattacgcatttcagggttatctactttattgacaaccaaaataactggtttgtttgtcttataaaggatacgcgatacatactcgtcagcatccgtcacaccttccttgcctgatacgacaaagacgataacatccgcttcatccatggcaatctcagcctgatgcttgatttgctccatgaaaggtgcatccacatcatcaataccacctgtatcaatcagggaaaacttacggttgagccactcaccagtagcataaatacggtcgcgggtcacaccttcaacgtcttctacaatagaaatgcgttcccccgcaatacggttaaatagtgttgatttaccaacgttgggacggccaacgatggcgatagttggtagagccatagctcctcctcttctagtttacaataatttattcttttctaagatagactttgtttctggttgttcagcctgaccaaactgggcaaccatacgctcagaccaggattctgtctgacgggcacctgcataggctgtctgaacttggtcgtaggcttggattacttccacgccttgctccacatattcttcctgaaagacaatggcttcgctttccaaacgtggtttaacaggatggttttgggctggtcgacccaaggcaatacagaaaatgggataggtataatctggcaagttgaacagctctgctattgccatggccttatggcgaatcataccgataaagaccccgccgtagcccagactttcagctgccaagagggcgttttgccctgctaggctcgcatcaacagaagaaatcaggagattctctgttcctttggcatcaaagtctgaaccatggagttgagccgccttgctggcacgattatggtcgcccacaaaaaccagaatagcctgagcctgtaaaatagctggctggggcaccaggtcatagagtgcctttttttcttctccgactgcaccacaatgatggaataagactggaaattcttccagctagatgcagctcgcccagctgatataatagcttgcaaatgttccacctcaatgggctcttccgtaaaacgacggacggaagtatgattcagcatcaaatcaatggtttcattcatcggcggttatttcctttcaaatgcaaatcgcgagccagatagcgaatccgctccataacccgttgggcctgccaggtctcatcaccagacttgccagatgcaaaatgccgttccaactcatcaaaggagaaattggaagtaaagaaggttggcagattttcctgcatgcggtattgaagaatgacctgtaaaacatcgtcgcgcacccacggactatgttgctccgctccgatatcatctagtaccaagacctgagccagcttgatttcatcaatccgctccttgacagagccatctttgatggcattttttatatcgacaacaaaggtcggataatgcagaatggtggtcgagaggtggcgattggttgataggcgatgggccatgtaagccatcaaaaaactcttcccaattccaaaatcaccatatagatacaaacctttatagtgttcgccgacctgttcaacaaaagcatcaatggcatcatagacctctatacgattactgtctgtgaaatctaaatcagcgatagtaacttttttgagagcctgaggcatattgatgagctgaatgcggttcttaatagcttccaaacgacggtattcgaccaattcctctgtttcaagataggacacatctgcatagccctcattcataaccaaaacaggttgatagccttttgcaatataagtctcatcttgtttgacaaaaaggtcacgctgactgatatattccaaaaacttagaaatggagagggtgatttcctgctgagtcaaaccttcttttttgataaaagcagcgacttcaggatcactcactatctcctgatagagttgctgataagattttgaacttggattggttgcctgcgacaacctgtcttgaactgatttcatcagctacctcccttactttcgttttctaacattcgtttcctaagcgcttccattcttgcctgagcttcaggactgttatccatgacaacctcttccttactccactcaggcacattgcttttctgtggctggctcgacttggtaacagcttgacctgtctttaactctcttagataaagaacagctgcctctgcactgccaattcccttgtaggaaaaatcattgcccagcttcatagcgtatttttcatttagattggctgagtccaccttgttaaaggtatagaggaccaagacattgataacttcgtcaagcagacccaaattggccaaatccgtcaagcattttcgttctgttcctgtcaccgctgccttccgttgctccttgataaaggacaggaaggttaggctggattttgatttcgcttcacgaacaatggcttgttcttgggcagtgaggttggcgctttctgttggcaatgactgacgtgactgctgcaagcgtttggtcgagatcatctgtccaatagctgttgctttagcctgccgataggtttccaaccaggtccaacctgcctgctctgctatgtaactaagcgcaataatatcctcagcttcatcctgaaaaagaagcttatctttagccattaatgccttgaaggcagaccagtcaaaatcatgtttcggttcaaaaacaactggagcctgcccatccatggtaaagacctgagaaaatgtttttgaaatattttgttcttgattgggttggtgaacaagcagattctccatacttgactccccaatcttccttgccaacaagttcttatacaagggtttcgctagaaaactttttacggtcagaggggcttgtagcgccaaacctgttaattcatctgcacgatagagttctaggagccccatggcagtcagaacatccagagccttctccaaacgattcatcccaaaatccatgtgattgagaatgacagtccatttgtaacgtccttgcccttgatcggcaaaactataaaagtaataataaagcgctaatgcatcaaaaccgataatcggctggtagcatttgctaagactgacaatatcaggtgtaaacgggctgatttttatataggcaaataaatcatttggtttcatctttttttcccggttttaccttacttcctttggagatcatctgcttaagcaaattttctagctctccaacatctttgaaagaacgataaaccgatgcaaaacgcacataagtgatttcatccaattcgaccaattcttccattaccaaattcccaatgacatcggattctatttcactatcaccttgtgctcgaaccttctgttcaatccgattcaccacttcatcaatatcatcggttgacacagggcgcttttgagcagaacgaataatcccattgaaaatcttttcacgtgaaaactgctctctagttccgtcttttttcacaacgactagagttttctcttcaatccgttcataggtggtaaaacgttgaccacattggtcgcaggaacgacgacgacggatggtattgccatcttcagcctgacgactatcaatgacacttgatttcaaactctgacattttggacaacgcatactctttctcctacataaactttatcacttcagtatagcataaaaatgacaaaaataaaagaaagcgagaattactcactttctaccaataattcatcttgcttcttcaatcgactggcaacccattcacgaaccaagcgatagacaaccgcaaaaattggggtaaagaagaccataccaagtaggccaaacaaattaccaccaatcagggctgcagccagggtaaagagggtcggaagaccaactgattgaccaaccacgcgcgggtaaatcacatttccttctatcagctgaataatctggaaaagggcgatagaccagagtgccaagagcggattttgtaccgccacaaagagagcactaatcaaacacgctgaaaagggaccgatataaggtacaaatgataggaccccagccaaaataccagccatgctggcataaggaattcctgagagcgaataactaacaaagacaagtgtcccaatgatacatgcctcaacaatctgactcatcaagaatcggtcataggtatcaacaataacttctccaatatagttcactactctgacagccttctctggcaaggtagcctgcaagaactttctcgtcatcgcctgcaagtgttccttgctccctaaaatcgctagagtgaagaagaaagccattatcaacgtcatagtgttcgaaaaaatccccgtcacattggacaccaagccagataaaatcggtgtgaccaaacttgaaataagtgttaaattcttcaactgatccaaaaagctggcaatctggtctccgatttgtcccgacaaaagaccatttgattcaagaaaattagtcagggcatttaccgattttggaatggctgtgctgctaaccgaaaccagttctgaaacagtcgtcaccaatgtaggaagaacaatcactaccagtcctgtcacaattaaagcaaatccaattaatactccaacaattgccaaagaccgcttggatttctttaaaaaagaaattttttcaaactgatcttctaattttttcatgggaacattgagaataaaggcaaaaatagctccaataaaaagcgaattcatactgcccaataattgttgaatagccccataaatactagaccagttgagaacagctaataatgtcgctccagataagagtatcaatatgactttttctttaaatgatgtattcataacttttccattcttacttattggctattattttatcacacgcttatagaaaaagaaagagggaaagcttccctcctctctactctaaatcaatcgcgcatggcatatccgacaccacgaactgtttttatatatgaatcttgatgtggcaaatccagtttaccacgtagatagcgaatatatacatcgacgacattggtctcagaagccgcttcatatttccaaacacgctcaagaagttgttctcgactaacaggctctgggctattcattaaggttgccagcagatcatactctcggcgggtcaaattaatcaattcatcacctcgagtcactgttcgattttgaaaatcaaccttcaaatcacgataggccgcatgcatgtgaacctgtttacagttattgtcaataaagtcacgaccacgaaaaatcgcagagatttgctccactaaatcactaatgacaaagggcttcaccacgtaggaaacagcataagagaggacttcttccccatattgactaacttctgtcggctcaactaccacaatcatgaccgtggctggttttatcgctaacagttctgtagccaattccttgctggacatgtctgaaagctgaaaactcatcagaatcaagtcaaaatccgtttcatgtgccaaggacatagcctctttccctgtcgatgcataatcaacaagatagtcttttttttgcaattccatggaaacaaaatgcgagagattgcgttctttaccagcaatcaaaattttcttagccattgtccatccttttctattctttcaaatggtgtaggaatcgtattatgactagaaagaagggcgcttccacgcccatcttttctattttgattcgctataccagtcgtaatggaagattccttctttatctttacggttataagtgtgagcaccaaagtagtcacgttgtgcttgaatcaagttcgctggcaagttttcagcacggtagctatcgaagtaggtaatagctgctgagaatgttggtacaggaactcctgcttgaactgccaaggcaacaacatcgcgaactgcctgttgatacttagctgttacatcaaggaagtactcatccaagagcaagtttgccaagtcttcatcacgtccgtaggcatccgtaatcttttgcaagaagcgagcgcggatgatacaacctgcacgccagatttttgcgatttcaccaaatggcaagttccagttgttttcttttgatgctacgcgcaactgtgcaaaaccttgtgcataagacatgatttttgagaagtacaatgcttgacggattttttctaccaattcagccttgtcgccttcgtatgcaaacggagctggttttggaaggaccttgcttgctgccacacgctcatctttgtaggttgagatataacgagcaaagacggattctgtaatcaatgacaatggcacacccaagtcaagtgacgattggctagtccatttaccagtacccttgttaccagcagcgtccatgatgtagttaacaattggtccatcttgaccttggtcatccttgcgtttcaagatgtccgctgtgatttcaatcaagtaactatccaattcgccttggttccagtcagtgaagatgtcagccatttcatccactgacaagccaagcaagtgctgcatcaaatcatatgactccgcaatcaattgcatgtcaccatactcgataccgttgtgtaccatttttacgtagtgaccagctccatctggaccgatataagtcacacatggtgctccatcttctggtgcttttgctgaaatttcttccaagacatctgccaccaattcgtaagcttctttttgaccaccaggcatgatagatggaccttcaagggctcctttttcaccaccagatacacctgtaccgatgaagttaatacctgagtttgccaattcttttgaacgacggatagtgtcttcgtagaaagtattaccaccatcgatcaagatgtcaccttcatccaagtgcggcaagagcgcttgaatggttgcatctgtaccaggaccagcttgaaccataagcatgatgcgacgtggtttttcgatagatgccacaaagctttccacatcgtaacttggtaccaagtttttacctgggttgcttgcaacaacatcttctgttttatcagcagagcggttgtaaatagctactgaatagccacgtgattcaacgttaagcgcaaggttgcggcccataacggccatccctacaacaccaaaatttgctttagtcatttgtttactcctctaatttgtatctcttttattatacactgaaagcttaaaattgacaagaattttcagataatttaactatcttgccaatctgagttagtcctcatctccaaataacccttgtaattgggcaaaaggactattggcttcttttttctcttgagctttttgttgaaaatcttcttcagtcattaaagcccaagctttaccagatggtagttcctgtccagcttcttcttcaggtgtcaagactttgattggtatagccagtaaaatattatctgctacactctcatcaaggacaatgtggtcatcttctactaccagtaccatatcctcatcaatcaaatcttgttctttaagaactgcttcattggcaacaaagagttcattgacgttttggacctcatgcaaaacaactggttgcagagaacgactggatgccaaggtaatatcataagtcatctgatagtccaagaaaaagaagcctgattcaaaacggacatttccagtgacttggactggcgacaagcctagaacttcaccatttcgagcttgcaattcttcctgtaaatccaaggttttatcaaagaagatgccatctagatttttctgaatatcgtaaatatgaaacattgtattcccctattcagctagttctgtgatgtagttatagacttcttgtccagcaactgcaccatttcctactgccgttgcaatctgacgaagttgattttgacgaatatcaccgatggcataaatgcctgattgggtcgtttccatcttttcattagtgataacccaaccagcttcgtctgtaattcctaggtccgcaactgtatcagtcatcggatccagaccgacatagataaagacaccaccgaagtccagttcgctgacttcctctgttttcacatttttgataaccacgctttgtacacgtaagtcatcgcccttgatttcttcgactacgctatcccagatgaagttaattttttcattggcaaaagcacggtcttggatgactttttgagcacgaagctgatcacggcggtgaacaattgtcacagactccgcaaactgtgttaagaagagagcttcttcgaccgcagaatctccaccaccgacaaccaagagtttttgtccacggaagaaggcaccgtcacagactgcacaatatgagacaccacggctattgtaagtatcctcacctggaatacctaacaaacggtgttttgcccccatggctagaacgactgtctttgtctccaaaacaccatcctcagtaatcactttcttaatttgtccttcttcctcaatacggactagggtgccaaaaatatggtccacaccgaatttttccaagggttcaaacattttttcagccaaggctggacctgaaatatggtcatagcctggatagttttcaatttccgcggtattgttcatctgaccaccataaataccacgttccaaaagagctacctttaaattgctacgccctgcataaagagctgcagtcatccccgcaggacccgcaccaattacaactgtatcgtacatatactttttccttctacgctttaaacattaataagattcccactactccaaaggctgcaatgggaattgtcatcacattaatcatcaacaaatcaaacaagaaatcttgtcgttcttgcaaggttttatccacaccctttgtcgcacgccagataaaccagaccagactagaagtgataatcaacaaggaagctattagcaatccttgtaaataaaaacttagaatgttttgtaacatctttttcctcgattactttaaaaggtttgacgcttggctttacgttctgcacgaccctttgcacgcgcttcaactcgcttggtcttgcgacgtttttcatcaacagcccattgaattttcttcttgtagcctggtttgacttttttctttttcttcttgaccaagccaatcatttccaaatctagtttttcacgagatttttcacggttagcacggcggtcacggtcgtaggtatcgacaaattcgccatttttcatttcttttggcaagaatttgatattgagtttttctagctctcgaatatctgcatcatcgcttggctgataaagggtaatggcaatgcctgataaaccattacgacctgtgcgccccacacggtgaacaaagaaggaaagatcctgtggaatggcatcattgatgacatgactgacgccctcaatatcaatcccacgtgctgctaaatccgttgcaacaatgtactgatagtccaagttcttcacctggttcatcatccgcttgcgctcacgtggaggaatatccccatgaatctttgcgacacgaagaccgttcgcagtcaaatagctatgcaattcatctgcacgtgtctttgtattgacaaaaatcatggccaagtaaggttgcatgagcttggttacttccaagatttgagcattacggtcacgccccttggttgaaatcagccagttttcaatggtatccgaaatgaccgtatgggtcttgatttgttccatgactggattggacaagtattttttcaaaaacggttggagtttctgcggaatggtcgctgaaaagaccataaattgcaagtcttttggcaggctgccagcaatcttatcaactgtttccaaaaagcccatgtccaaggtcatatctgcctcatcaaccacaaaggttttggctttatggatagcaaggtcacctgatttgaccaaatcatagatacgccctggtgtcccaacaacaatgtgaggctgactagcttgaagcttgtcaatttgacggttcttatccgtaccgccaacataattggtcacacgaacttctgtgtccgaatgactagccaactggcgtgccgcttgataaatctgagtagccagttcacgagatggggctgtaataacagcctgaacttggtccaattcctcatttaatttttgaaaaatcgggatcaagaaggtatgggtcttacctgaacctgtttttgattcccctatcaagtctcgccctgacaaaacaacaggaatcaatttctcctgaacttctgtcggctggacaaagttaatttctttcaaagcctcctgaatataaggcttgagtttcatatctgtaaatttcatagtttcctctttagttgtattccctctattatagcacgatttaggtggacaagcaaaaaggacggatacccgtcctaatcaactctcacttgcttcagtaaattctgcctcaataattccaagttccttctcttcttccaaacttgctttaaaggcctcagtgagttctaattcgccatcaaaatcaccatttatttttttcacaaatgtgtctgccaacatccctcccatgggctggaaggtaaaataggtcaaacctcctgaaatcagaccacccaaaataggaactgcattggcaatggtcttttcaacagtctttttggtaattttcacaccaatcactgcggctacctttttcaccaagggataccaagttgtcttggtcaaagcctgcatagctacttttttaccgatattagctccgactgtcttggatactttattgagaagaactgctgaaccacctgctccaaacatgacaccaatgtaggcaataatgcggatttgaacctcttctgaaatttccttcccttcaccaacaaataattcatcttcaccaaaaagataagcgatttgttgcgacaaattcaaggcaaaaccaaaatactgagctatatcagcagtacctgccgccaccgctgtaaatggattccccggtaaaccagctgcgaaagaaatcaaagatgttttcgtagtcatatcattaatgattttttcagcttccttacgcaaagcttttgtagtgaagaccgccgttggtccatccgcaataattttatctagatagggactatctttaaaacgagtcttcaaaaattcttcccgattgactttaaccataggaagttgactagcagctgtcatggtttgaataaccactccatataactgttcttgattgaattgttccatttttatcctccaccaattctctctctattttacccccccccgaccatatttgtcaaggtaaaaaaacagcatttctgctgtttctgacattttatagataaagaatagctagggtaatcaagctcatgatgagaccgactgaccagaggaaaaagtcaactttccactcgctccatttttcagcttttccggtcaaacctccaagctccaaatggtgatgaaaaggagtcatacggaagatacgacgaccttctccaaagcgttttttggtgtatttaaaatatgaaacctgcaacataacagaggacgtttcaatgacatagaccaggccgataaggaggagagtccattcctgacggagggcaattgaaatagttgccaacataccgccgagagccaagcttcccacatcccccatgaaaatcttcgctggtttacggttataaacaaagaaaccgagcaagccaccaatcatggtcacacaaactagaagaatatcaaatttttgctcattgaaggcgatgacagagtaagctagaaggctgataacaactgagatagaagccaatccatcaatgccatctgtcaaattaactgcatttgaaaaaccgaccagccagaacagaacaaatgggaaatagagaactcccaaatgtaccatgtgaccaaatacattcaattctccgccacctgctcctcttacgtggacaaagtagaagacaatacctcctaaaatttgtagagcaagcttttgtttaggattaagaccttcatttattttacggaaaatttttaaaaagtcatccaaaaatcctactacaccataaagggcaaggatgaagaggatggcaaggacaccacccgtcaacagttgaaaggccgttgcaaacaacaagctgacaagaatcgcaacaacgagaaaaactgttccccccattgttggtgtacctgccttaaactgatgttgtttcacatcttcgtgcatctgttgcccctcaatgcgtttggcttgataaaatgtaataaatcgtgggattaagagaacggttgctagaaaagctaccaatcccgacataagtgcgaattgcatgtcagtctcctaaggttattgttattttcttggttttattcaaagcggtaccgacctctacactttggtcgactacttttgaacccgttcctttataggtcacttcgataccagtccattcagcaaatatatccatattctctttggtgattgcgtacaagtctggcatttcttcgaatttatttgtcaggagtagaacctgttggttggcgattaccttacttcctttttcgactgaaacttttttaatttcagcaccgtttccaaggataactggttgaactaattgacggcgaagttcctcagccgactcgcctggtgccttaccaatgaggtctggcaattgatactctgtctcattagcgacccgtgccaatgctggtgcaggtgaatccagattcaaattgtctttcaacagcatcgcttctttcaatgtaggactgacaatgtcacgccaagacaggacatttaatacttccggttggcgaatggtcacatacatgataaattcagggtcttcagcagggatcatggctactacagagttgatgtaggcacctttaatatacccttgaccatcttcgctggcaatttccgccgtacctgatttgactgcaatatcatagccgtcaacctgaattgcaggcccctgtaagtcatgtgagtagagcgtaccataaacagggtcagtaccgacattaatcatatagcgaagtgtatcgtcggcagcttgttcagaaactggatttcctacttcttctttcgaagaaactctagctgtatctgtattaggatcataaagagctgagataaatttaggctctagcataataccattgttcgcaatggcggtaaaactacgaagcatctgtgcttggtttgcagaaatcccctgaccaaacgatgacatggcgatagaaacaatgttatcctctggtaccattcctggcgcctcgtcccccataccaaaacgcgttgggtagccaaaacggaacttagtgaggtaatttagccatttttcatctcccatctgttgctgcaataaggtcatcccaacgttactggatagggagaagccttgcgcataattgagagtcacagctgaataacctgcattgagggtccagtcattgattttcgcgtctgcaataacgtactcattattggtataatatgcatttgggtcaaaggtgccgttatcgatagctgacgctactgttagcaccttcattgttgaaccaggctcaaaggcctcttgatataagagtgaccgctctagcagtccttcttgtcccagaccttctttggtatctgaatcatagcttggcctttgggtcgtcgccagtatttcacccgtcttggctgaaaccaaagttgcattcgcatatcgccctttggcgttatcaaaaaaggtattcatattggtttcaagagaacgttgtagatcggctgaaattgtcgtatagacatcctgcccgtttactgtctccgtttcaaccttttctgtcccaggtaggacacggccttgactatctttctcgtagataacctttccgtcttgaccagccagaatatcattcagataatattccaaaccactcacaccctgtaaactatgactaccatccttgttttcaaccagattagctaacccgacaaaaattgaagcaaaatttccattcggatacatccgtcctggactagcgttaaaggcaatcccttcaatacctgccgccttcatctcttcttggattgacgacattgtactataggagatattcttacctaaggtcccaaagtatacctgcttcagttcaggttgattcagctgctccataacataatctgtctccattccgagatgctttttaaagatttctgctactttgctgaactgagaagactgcacatacaaaacttttttcagttctgacacatattctgtgtcaatgatggcatagactgtataggtcgttgaatcttccgcaataggaattcctgtacggtcgtatatcgtcccccgtttagcttgaacgataacttcacgctggtgtaccgcatcagctctctctgacaagtccaccccaaatttactatcggtgccgataatataggcaaagttgattaaaaagagaaaaaagacgaaaaccgtcaaaagaagtaggctctgtcctactcttcgacgattttttgacggaacatatcgttttttcaagacataccgcaagagtttattatttcttctgggcattattcggctactccaatattgtcattattaaaagttaatccagctttttcagcaatttccatcaagcgagctgaacgtgtcaattcattgacagcttgcttagcatcgttaatttcaatctgtttttggctaatgtcttgattgactttggccatgctagattgaagttgcaaaagccgcgtttgcataaagataattcctatcgcaagggctaatccagataatacgatgcttgaatagaaggctttttctacacgtgtgaaggttctaattttatcaccgataacccgcatagtggcttctctacgtttttcttgcaacatagactctctcctatttatgtactttcttagctacacgcagtttggctgaatgcgcgcgattatttgcctctaattcttcttgactaggtaagataggcttacgattgaccaattcaagtggcgccttcaagtcatctggaataaatggcaaaccttttggaacatcaatcgtacttgcttctttgaagagttgtttggtcaaacgatcttctaaagaatggaaagtaataacagaaatccgtccatccaaagccaataagtcaatggcctgctggatagattcgtctgctgcccccaactcatcgttgacttcaatccgaatcgcttggaaaatctgcttggcaggatggcccttcttcttaagttccttggctggcttggcagatttgatcagctctgccaactcagtcgttgtttcaatcggcttgaccgcacgcgcctgttcaatcttacgagcaatctgcttggaaaatttatcctcaccgtatttaaagaaaatccgtaccaagtcgtgataatcatagttattgaccacatcataagccgtcaaatgtccctcacgattcatccgcatatcaagcggagcatcttgtttgtaagaaaagccacgctcccgctcatccaactgtggactagatactcctaaatcataacaaatcccatcaatctctgttacacctagctccgccaagcgagtcttgagattacggaaattatccctgataaaggtcacttgtcccttttcaatgtaggatgccaagcgaatatgggcatgatcaatagcagtctgatcctgatcaaaggcataaagatgcccaccatccgtcaactgactgagcaggtactcactatgacccgctccacccagcgttgcatctacataaattccattgggtttgatgtctaacatatcgactgtctcatgcaagagaacagttgtgtgattaaattccttggtcatatcttttccattgtaccacaaattaaaataaaaagttgttgcaaactttttacaaaaaaactgtcaaatatagttgacaacttatatgaacaggtatatactaacagtaaagaaacatgtcacatatagttgacatcaacagggaggtctcccacatttttttacacttgtatgtcggatataattgacaacaatttaaaaggatagtcaacctatcctctcatttttagccaagtatgtcagatataattgacatagaaaggagggcacatgaaccgtgtcaaagattatcgcctattgcttgggatttcccagctggatctggccaaggctatcggcgtatccaggcagaccatcaatatgattgaaaacaacaagtacaacccctcgctagacctctgtatcaacctagccaaagctttacagactgaccttaatagtctcttttggaatcaataaggagttcatcatgaaagatatttttacaaaaattctcaatcaagcaaccaaggatttttattccattagtggtcccatggatgaaatgcgtctgcaagaaagctatcgcctcagtaacaccattgtcatgattgtttttcctatcctgctaataggaaatacgattgcacttcttattgccctacgacaacctgaaaaagttggctttctgctccccctaaccaatatactaatcatcggtttcacgcaagccttagcttcccaccttgccttgaaaaatggcattagtcaaagctatgaggatgaaattaatgtgaccaagctcaataaatctcttgtaaaaagtagtcgtagcacatttttcggagccttcctggcttccacgactgcccctgctttctataaagaatggtctgtatttcttgaagaactaacagacccgaccctcctactaggtcggttaattgttgcaggagctatcaccttcatccattactactattgtaagaagcagttacaaaagaaaattctcgcaaacaaataaaaggaagaaaaaccatgaaaaagaatatacgtcaagctcttatctctacccttatttttatcccgctctttgtcctctttcagctttggggcaatagcggagcagaaatcttgcacaccatcagccaagcaaaattttggctacaattgctgattgctgggaccatctacttcttaggctttgtttacatcttaccattgttcgttcaaaaataaggagctgcttatgaaaaaagaaacctttcaagataaattaatcaaacgattttacggtatcgcaggacccttggatgaatttcgccaaaaagaagcctcccgactaggcaatacctgctttatcctgctcttttggggcaccatggctcttaccctactggcactcgctctatccaaacgctacccagaagtcgttgcctatggctacccaactgctctactcctatccactctttcctccagtatgtatatgacatccaagatgcgccacagccaagtggacagtttagatgtagaggaactgactaccaaggaacagaagcagctcaagggagcaagtatcaaattcgccctctatttcactgccgttatgtacatttggactgttgtttttggtgcctggatggaggggctcaaccctttcgaccacctatttgacctccgaaaattccttgcagcctgtctaggtggtattttcacgggcattgctcttgaaatcatgttacgcaagcgcatgaaaaaggcagaaaacctaactatcagctctgctatttcaaaagaagaacccaagtggatcaaaaatatgattaaacgtttttatggtatccgcggtcctttagacgaataccgacaggccgaggctgatgctatcggcggacaggcctttatctactacttctacttcctagctcttggaaatgccatcgcctacttcctagcctaccgctatcctgtggaggtggctgcctactatccaatgataattgccttcttcagtattatcctaattggtatcgttaatatgcgcaccctccatgctgacctgcctcaatatgacatggaggaactaagtcctgaggaaagacaaggacagaccctcaatccactcgtttggggactgggtgttgccctgctatctagcctctttgctgggctgtcagacctctttagcctccagcttcccctactggcctccagcttccacgtcaaatccctcctcttcggtggtatgatgggcctctttgccagtctagccctgtctgcccttgcctatctgcaaaaactggaagcagatactgccaagaaaaaataaggagcagacctaatgaataaaccttttacacccaaacaaacctgtcgattttttgttctattttatgctttattttctgcattcttcatctactcttacatggtcaatgagccgattagcggttcattcttgctcatgttaccgcccattcagattatcagatcctttaaaacagaagaagaaaaacgatactttatcattcaagccatctttgccctgtttgccatgaccttgacctattccgtgggcatttggctaggacatgtcaaaccacatatcctcatccttcctgctggatttgctctggctattctttatcgattgtatttcaaaaaggagaaaacagatgaacgttaacaaaccgaaacttatactcactttgattgttctctcctatacaacattttgtagcctgtatatacatagctacctgactggggacaatccaccaatctttatcttaccgttcactatacttccaatcttgaatagtgactggcaaactaccagtccagaatcaaatgctgtccaagaagctatccatctttatcgtaaaccactgctatgttttctctttgcaggtcttgtcctaaccttctccattggatttttcactggtcaaatcaaaccactcctagctggattttggggaatatttgctctcctgctctttattggacaattgaaaaagtagtctgtatccaacattttacaaagtaggattttttctataaaatagattgtatatgacattcaaatccattctcaaacaactcaaactatttgattatatcttaatcggattcaccctagttttatcctttcttccagcaatttttacctacacacaactgacaacagatgcaaatgaggcaaaaacaattgcctatgtccgcatcaatggtgaggtggtcgaccaatttgaattatcaaaggacacaccccgtcaagaaaagacctactatcccaatgaagggcaatacaatatcattgaagttgatggcgaacgcattcgtgtcaaggaagacaatagcccagaccaaatcgccgttatgaccagctggattagccagccaggtcaactctccgtctgcctgccacataacctgttgattgaaatcaaatccgttggcggggaaaacactgacgaagaagaacttattttaccactatagtcttttagtttacttttagtactagctccaaaggtttgggaaatctttggaggttggagataaagcgaacaaagttcgcatcaaaagccgcaggcataactcaatgctttcttatttctaggcattgacttgaaacagtcccccagactgtttcaatcagacaaggcgagttcaaatactccagtggagtgtttgaagttggaaattaggaaacgatgtttcctcgctcgtcgaagtaataaaagaaaaactaaatgacgatataacaaagaagacacagcctgatgaacgactgtgtctttcctttttagaaaataagggctaaagcaagtatcaccacatatagcagcgcaaagagtacaaaactctttactgcctcgataaaggtttcccgtttgagttgctttttcaaaaatgtttctagactcttataagcaggccaaactccgattaaaccggccaatgcccaaattggtaagaatcctatcagacagtagattatccacagcaaccatggtaaacttgccaagacaaaatacaatttaagagcatttttcttgccaatatagtaaaccagagtataacgatggttgcgaatatcttcttctaaatcacaggtgttgttagccaacatgatattagcaatcaaggttaccagaggaatggacatgaaaataatttcaattatttttatccaagaaaattgcaaagtcatccactgaccgctcacttggctggtcagtagcaaatctggttgctgaataaatacagcaagaaagaagatgccaaatcccatggttactccagagaaaacttcacccagtggcattctcgaaagcggaataggtccaaaggtatagaagataccaatgaggaaacagagagctcccatcggtaggaggagccaactggtccgccatacaaggagtaatgaaaccagtagagaaaaaataagtagagcaaggacgattccaatcatctgacgaaaatctagggagaattttccaatcacattgctttcctgacgataggcttcatccttggccttgtggtagtccatgctattgttgatggcagttgtacacatgtcaaagctaaggacggcaataatgaagaggagagtattgagccaattgaaagcttgatagcgatacaggctccataaaatccccagggtcatcggaaaaacactagctaccttggtcttcatttcaacaaattctagaaatacagacaaactgagccctttagttgatttattcattaacaagatgatactcctcattcgttaattcaaagctttctttcaagccatcactcagatgaacgccctgctccttatcgataaaaacagcttctacaccgtcaatctgattgataaagtcaagacctttttccacacctagtaagaagagagttgtggagaaggcatctccttggatagatgttttggaaaagactgtcacacctgagatatcgttttccacaggatagccagttttgggatcaaggatatggtgatatttgacaccgtccacctctaagtagcgctcataaatacctgaggtaacaaccgaatcatgtgtccctggcacagaaccgaccgttgatccacgcacttggtctgggtcttgaactcccacattccaaccattttgtgtcgttggcgaatcccccataaccactacattcccacctagattaatgatggctgtcgtaatccctttgcttgcgaacaattctctaaccttatctgcaatataacctttggaaatggctcctaattctaaggtcattccttctttgataaagacagtcttcttctccttatctaaagtaatgtctttataattgataaatggcagagcagctttgatttcttcatcactcggcttacgtgcatcctcatctccaattttccacagattgctcacagctccaatggaaatgtcaaatagcccctgactttctttactcatgtcaatagctgtttcaatcacttcaaaggtacgttcatcaaccttgacagcttcttttcctgctgcctgattgatacggtagacatctgccccttccaagtttgtggacaacagactttccatctccttgatataggagacagcttcatccatcgcttcttcctgattttcatgataaatactcaactgcactactgtgtgaagtaagctttcactacgagtcaacggagttttcacaacagataaactttcgttttgtttaccaccacaggcaacaagcaaaaccatcagtaggcccacgaacaatagacttgcaatttttttcactgattttaccttcccccaaaaataagaagacacagtagccaaacaagtgcgactgtgtcttttctgtatagacttaattagtcaagttttacagtttctgtttttccttcagcagctgctgcaagaagggcttctgtactcttcttgaagtcttcagaagtatgagttgcacctgatacaacttcaacagctgagaggtcttgtttctcaaccaaagctgcattgagttgttcgattgcttcaccagcagaaactccagctttatctttcatgtttttgttgtactcttcatttgctgatttaagacttccatcttcagcttcgtagtcaaattttgactcactgatttttccgtctttaacagtcaatgtgtgaacaattttgtagccataatcgtctttgcctgactcagctttgtaagtaccatctttcaatactactgtttctgtagttgaagatgaagttgaagtagattcttgtttagaaccacaagcaacaagtgcaaataccgcaccaagaactaccaaacttttcaacacaactttagttgttttcataacaatactccttttgtaaagtaaatagttttatacttataatgatataccgaataaactaaattgtctagtatttttttaaaaataatgactaaaaactattgccaccaaattttgcatagacgcagtcgataactgtgatattctatctacaaaactcatcattttttccaaatagctaacaatcagtttctctgttttggcaatagcatgcgttgcaaaaatcctatctgtaaggatttccaacccttctgccgtaggggattgaatataagcccgcaattgctgctggatagacttgtcttctcgcatggcaaaaagtagcggtgcagtatagataccgttttgaatatcttgcaatctaggttttcctgattctgccacatccagctggtagtcaattaagtcatctcgtaactgaaaggccatgccaagtgcttgcccagaccgaaaagccatgctactgtctttcctagattggcctggtacaaaactccccaactgacaggcaagtccaaatagaaaagctgtttttccttgaatttgcttgagataggctttcatagtcatattggcatcaaattgattgagtagctgagataattcccctcgaagaattgtttccatcagcttatcattgcccaaatccaaatcatcacgtgacacctctagcaaacgaagcccctttccaaatagtcgacttgaataggccagaagataatcacccgtgtagatagcgattcgattcgaaaattgttgatgagccgccgtgactccccgccgtttatccgcgccatcaatcacatcgtcatgaataagagtcgccagatgcaggacttctaaatgggcagcaaaatatagctttgaacggctaatctttccttccgtcatttgtgcaaagagcagacagaggccggcacgcaggtatttccctggcgcctctacatattcaacaatcttcgctgtaactgctggatgcaggaccatcatctcagataagatgatggattttacctcttcaagtcccctctcaatctcaggataggtattccaaatttgatgtaccactaactttctatatttcctttattttttatccttgatacggtaaatatgcttcggctttccataaatcttcttatctaggaaacgacccaaccatggcataatccagtagtctagaccgaaggctctacccgcaccattcataagagaaatagctgctgggatgaaccaaatatttacccagtagaacatgcctgacaggctgaacataactaccaaagcaacggttgcagcagatacaatccatacaaaggcaccagcaatcaaagccagaccgataccgatttctgctactgtcataaatttttgcataaagagtgctacttcttggtttggcatcataaattccatgatagtagcaaaccaatcaggcattttgtccaaaacagccatcggtgcttcaccataagcatagctcaaaccaaaaattggttcagctacttctgccgcagcagttgccgcttgtgaggcacttgaaaccgcctcagcagcagatgctccagatactggatcagctaaccaagggaatgggaagacaacttgatccccaaaccatgatgttgttccaaatagaccaaaggctttcttgataccttcgtagagccatactgaaccataaaggacacgcattggcacagaccagagaagatttcctttgcctgaagtatgaccgccaaaaatgtttcgcttattctgaatgtcaaagaattcatgacgaacataagaacccatgtagaagaaactacggatagtaaagaagtagagtaggtttaccatgtgtttgacagccattgccataaagcctgacatgtggtatttgtccatcaagaaggctacaccgtagcgtgctccaatagataccataaacccatcatatttacctttgtagctatgtttttcgccgcccttgattgctgcaataatattacttgccgcagtatggcctgtctgttcagctgcttgtacaatctgtggagttggttttccttctgattcttcaaagtaaaccaagtcgccagctacatagacattttccttgcctttcgcttccatgaactcattggctatcaaacgacctgcacgtgctttttcaataccaaattcacttgcgtctgtattggcttgaacaccagctgtccaaatagaggtataggtaggaatttgacgacctgatgaaagtgtcaagctatcttcttgtacacttgctacaccatcgccaagaaccaattcaacaccttttttctcaaggtatttgcgagccttgacttgctctttttcagtaaccatagccaagatatttggcgttgcctcaacaaccttaagtgagaattcttttgaatccaacttgaactcacgcgccaaaattggtacccagtcaatcaactcaccaatcatctcaatacctgtgaagccagcaccgataacagtaaaggttaaaagagcgcgacgtttggcttcatcatgctcacgcatggcacgatagcaagcgtcaatcatgtggtcatgcaaacgttctgctgcttcgatagaccaaagtgtaaaaccgtgttctttaacacctttcacaccaaagtcattagcctcaccacccattgcaaggagcaggtaatcaaaatccagagtttggtgttccgcaactacttgtttcttatcgtagtcaatctcaacaaccttgtctgttaccaattgaacctttggatattttttgaagatacgttgaaggtcatacttgattgcattggcttctacacgcccagccgcaacttcatgcaactctgtcatataggtatggaaagagttcttatcaatcaaggtaactgttacatcttgatcctttttaaaagtttttcctagcaatcgagctgctgcaatccccgcataaccagcaccgacaatcacaatatttttcgtcacaatgtttcctccttgtgaaaatcaaaacaaattacatgtttccattatatcgtattccaagatagttgacaagcaaatttcaataattagtaatatacacaaacaaaacttgccatagtgaacaaaaacaagtatgatagtaaaatagataatcgactagaaagagttttttctctacacccatgaattctaaacgtcaaacacttaactttattacgatgctagcagctcaggcagttgtcatttctttgattgaacgactcatcacccccccatttgcttttgctccaggcgccaagctaggactgggaaatttgattagcttaattgctatttttaccctccctacaaaggatagcctaaaggttgtcgcactacgcttgctcatctcaacctttctgggaggcaccttttcaaccttcctctatggctttgccggaactactttgagttatgtaggaatgctctctgccaagcagctcggtccaaaccgtgtcagtcctattggaatttctattttgggcgggatgttgcacaatcttggtcagcttcttgtttttgctaccatcgcccgttctttctatgtactgaactacctgccaatcctcgcttttacaggaattttatcaggcttattggtcggactggctgctacctacctcctccaaaaggtcggacctttacgtcactatcatcaacaagtcttagcagaatggaaataaatctccctaggtcaactaaggagattctttttatggtccgcaccactttttcattgtccataataattcccccataatcctggtgtcacaaatataatgagccacctcatataaacaccacttataaaatccatggtaataaaaaataatgaagctttcaagaagagaaaaaaatcaggttctttgcgtgttttagtcgtacattttctttcttttgtgctacaatatcttcatcttttatttttttgagaaaaggtagaattatgtcaccatttaggatcaaactttctcccagtcagcgaatcattatcagtttcttattcgtgattctgactggatcaattttactaagtcttcccatctcacaaattagcacctctacagcaagttattgggatcatctcttcacatctgtctccatggtttgtgtgacagggctatttaccaaagccgttgctgaaacctattctacttttggacagattatctgtatgatgttaatccaaattggtggtttgagcttgataggatttattggtctcttcgctctacgcggtggtcgtaaaatgaatttcatcaatatggcgaccttacaagaggctctaaaccgatctgacacaaaatattttcgtaacttcctcaaatcagcttttggttttaccttggcggtcgaagcctttggagccctcttactgtcctttcattttgtacctgaatttggatgggcgagaggtttatttacctcgattttcgtagctatatcagccttttgtaatgctggttttgataattttggcgcaactagcatcatgcgctatgtggataatcctctaatcaacataacattagccagtctcattattatgggaggtcttggattctcggtttggtttgaccttcagacacaaatcgggcaaaaacgtagcctacgaaaactagggttccatacaaagattgttctaggcctgacagccattatactgaccctcggaactctgactaccttactcaccgaatggaacaacccttctactatcggacaactatcatttggccataaattattagccagctttttccagacggtcaccatgagaaccgctggttttgccagcatcgactatacgaaggctgaaccaatcaccctcttgctctatatctttcagatgatgcttggcggagccccaggtggaacagccggcggtattaaaataaccgccttcctaaccttagtgctctatgctcgtagcgagattctcggtctccctcataccaactttatgggacgaaccatcgataacctcagcatccgcaaagcttttgcgacattctcagtcttcctacttatgtttatcatagggctcttcgcacttgccctaacagatgaccgacaaccacttctatttttaatgttcgaggtcatgtcagcattagccactgtaggtgttacggcaaatctgactccaagcctaaccatggccggtcaagcagtcattatggcgctcatgttcttcggccgtatcggtccactttctattctcgcaagcctttctgttcgaaaattatctaaaaccgaaagtcttcaatacgcaaaatcatctatgcttgtttaaaaggagaaatcatgccaaactatactatcggaattctcggcctgggagtttttggtactaccattgcaaaaacattacacaattacgattgcaatatcattgctatcgataatcatgagcaacgtatcaatcatctagaacctattctcacacgcggtattgtcggagacatcaccgatcgctcgctcctacgtgcagcaggaatcggtaactgcgatgctgttgttgtagctactggcgaaaacttggaatccagtgttctggctgtcatgcatagcaaagttctaggtgttcctatggtcattgtcaaagtcaaaggaacaactgcgaaagaagtccttcttcgtgtcggtgccgataaggttatttctcctgaacgtgaaacaggtatttctctagcaaaacaactactccaccgcgatacaaccagcctctttgagctcgaaggcaatgtttccattgtcgagtttcacccgccagtaaaatggattggaaaaacactcggcgaattaaaactccgccaacattataaactcaatatcatcggttaccgaagtggcgaaaatcaggaattaaacatccaactgactcctgactatgtcttcaaatctgacgaactcatcttagcagtaacagaccataacactgtcgatcattttgaagaactgacaaattaatactcaatgaaaatcaaaaacagactagctccaaaggtttggggaacctttggaggttggagatagggcgaacgtagttcgttactacttacgcagatagaaccctgttactattttgtttcaaggtaacaggctgaaaggctccactggagcctttcactcatcaaatcaagtcaacaacgtctgattttgattttcgaagagtataaataacaaatttacgccctatactccgttttcaggagaaatattttatccctagaaagcctactagactatcatttatctagtgggcttatcatctgtcaaaaggagagattatgaatgatttaaccaaaggaaagccgattgcagtcatcttacaattcgctattcccttattgattggctctttttttcaactggcctataattttgctgattccatgattgtggggcatactttgggaaaggattcctttgcaagtgtcggttcgacagccagcctgatttttttaatcatcggttttgcccaaggtgttaccaatggattaaccattatttctgcccaacgctttggagctggcgacttagaggggcttaaaaaatcttttgtccacggactcttctacgcttccctcatcagccttttactaacagtctcagccttagcttttttgaaacctatcttggtcttaatgcaaacgcctgtgagtatcatcgaccactcccatgcctttctaacggccatgtttggaggattgacctttactattttctataattttctttcttcagccctacgcagtctcggaaactctaaaacacctctactggctctagttatcgcttgttttatcaatatcggtctggattttttctttatcttagttatgaactggggcgttttcggagctggctttgcaactatccttgctcaagcctgttcggtcctctttcttattttttacattatccacaaggtacctcactatcatatcggactagctgatttaaaattggatagaggtaatctcaagaaacatgcccagcttgcttttccaatgggatttcaagccagtattatcgccatcggagccatgaccttgcagtttatggtcaaccaactaggaacagacgccatcgccgcccaggccattgcccttcgtactgaccagttggctatgctgcccatggtcaatctggacttggctatcgcaacctttactgctcagaactacggtgccaagctctatgaccgtattcgagaaggagtgcgccactcattactcctcagcattgcttgggccattgtatttgcggtcattctcatcttgggcaatcgcttcttctctggtctctttctgccaaatgccagccaaacagtgctggacttggctcttgtttactacatcattaacggctcttgttactggattgttgcttccctctttattcttcgtagctttattcagggacttggcaagggctttatcccaacactagcaggctttggagaattgattttccgagcagcagtcgccatcatcggcatgcagtatttcggtttttatggaaccgccgccgctaaccccgccgcctggatcggaagcatcatcgtcctgattccaagttccatcatctttatgaaaaaattaaaagcaggacaaagtatttagaaaagaaaacgcatgaaactctcatgcgtttttaaaatagtattttcgtaagaattggatatgaaggacattccaaagcatagcatagctgatcgccactacaaaagctaagccatattgccaattaaattccaacacaaggctaacaaaaaggaatattcccagaaggaccaataataaactacttgcctttttctcatccctcttaaaataagccaataaggctttatcaggagaagctttcacttccttgaactgtttgaaactagcaccaagacttgctcctgccgctcctataattgcaccagaataatagtgtggaaggacatagaccgacaaataagcgaccgtaacataggcaagcaccaacaaggcatacaccagttttttcatgaccaacctccctatctatttgtttccgtccctattttaacataaattttatcgtaaatacaagtcaaaataatctactatggcaattgactttctaactcaacttctgtcaagagcgggctataataatcctgctcatcagcctagagcgggctgttgggtagcattttttagtctgagccagagattttttcaaggctttgctatagtcaaataaagagcttttagacaaggaactgaggtgcaggtagttagaacaacctctaggctgttctagcttggaaataagacttgcgaaacaagtcactttcgtagagtatggcaagctgaaagtgacgatgtatcaaagctaattcaaatgactatatctcgagtgattcgttattgtaagtaggctgcaagcacaaaaaaagactagaaaacctagtctttccttgtttattatcatttattcttaggaatttggatcatccaaactacggccatgcaaacctttttcacgttggacttgacggagtttctctggcgtcacatcattgccgtcttcatcgacgaccttgataccttcgatgtgggcacgcacactacggcggtagccctcgatgtactcctcacgaagagctgcttgttcctgcaactcctcctctgtcaagccttccgcctttttcttgcgggccaattcattgatgcgatcgatttttgcttgttccataaatgcctcctacttgctattcaagagattgaagaccgccacagcacttgccttatccgccaaggctttcaagagagccaagcggtttgctttgactgttgcgtcatctaccataaccatggtattgtcgaagaaggccgcgatgactgggctgagagcaaagagcttgtccaagttgcccgccatatcttctgtcaactccaagcctgccactgcagcagcaagggctttttcctggtcgttttcgaagagggcctcgtcaatcgcagtcacctccgccttttcagccaagttgaagacacgtgacaagttttccacggcttccttgtagtcagcctcttttgctttttggaaaatagcagagctggctgccagttgcagtctgaccacaaaagttgagctggcaagtacagcctcgcggatgtctttcggaatggtcttgtccatcatcttctctacacgagcacggataaagtccataacagctggctggttgtcataggtcaagctagcaaaattcaagctgtagagctccgcaatcaactgatccaatggaatttcccaaccaaatgcttccaaaatccgcacgataccctgtgttgcacgacgaagagcgtaagggtcgtttgaaccagacggaatcaagccaactgagaagaaggataggagggtgtcaaacttatcagccagtgccaggaccgcaccgaccttgctctcaggcaattcgccttctgctgagtttggcaagtagtgctcacggattgccgctgccaccgcaggtttttcccctgcaagaagggcatacttctcacccataatcccttgcaattcatcaaactcaccgaccatgcctgtcaagaggtcaaatttgtagatgtccgccgcacgcgccacatctgctttttcacccgcagacaaacctgccaagtcagccagtttttctgcgataactttggtgcgttccatgtgctcgtaaagtgagccgattttctcatggaaggtcacaactttgagtcgctctaccaagtcagcaatcttgagtttttggtcctcacgccagaagaactcaccatcttccaaacgggccaccaagactttttcgtttcctttaatgacattgtcaaggtactggtcattaccgtttcggacggagatgaagtttggcaaaagcttgccagccttatcccgcactacaaagtaacgctggtggtttttcatggaagttaccaaaacttcttctggtacttccaaatatttagtgtcaaaagaacccatgaaggcagttgggtactcgaccagattgagaacttcgttgagcaaatcttcatcaatttcaactgtcacgttgtgtttgtcctcgatagccttgatttgctcgacgatcatattttgacgctctgcggggtcagtgataacaaactgtgcacgcaagtctgcctcgtaagaatctgcacttgcaatctcagtttcatttccaaggaaacggtgaccacggctgatgcgaccagatgtaatgtccaagaagtccatatccaatgcttcatcgtccaaaagaacggtcaaggtgtggacaggacggatgtaggcgaatttgttggacgcccagttcatgctgacagggaaggtcatagccttcaagacctctggaatgcccgccaaaactgtcttagctggctggcctgcttcgtgtttggtcacataaacatactcttcgcccttgatctcgcggaattcaatgtcagctgtcgtcaagcctttgccacggacaaaaccttcagcagccttggtgaagtttccgtctgcgtctaaggcaatcttcttagcaggacccttgaaatcttctgtaagatcagtctgctggtctgccaaaccacgcacacgaacagccaaacggcgtggcgttgaaaagacatcaatgctgtcaaaagccaagcgattgtctgtcaaaaaggtcgccatgcggtcacgcaactggtgcatggctggggttacgatgtaggcaggaatttcttccaagccaagttcaacaagtaaattctttgtcattattctgcgtcctccttcaacaattctgctcgtgttgcttcatccaaaagtgggaaaccgagttttttccgctctgccacaaaggtcttggcaacgacacgggcaaggttacggatacgggcgatgtagccagcacgctcggttacagatacggctccacgggcatcgagcaggttaaaggtatgggaacatttgagtacatagtcaaaggctgggtgaaccaatccttcttccaaagcccgctcagcttctttttcaaacttagtgaagttttcaaggagcatgtcttggtcggatacttcaaaggagtattttgaatgctcatattctggctggataaagatttcaccgtatttaacaccgtcagcccattcgatatcgtaaacggagtcaacttcttggatataggaagccaaacgctccaaaccgtaggttacctcggctgtaacagggcctgttgccaaaccaccaacctgttggaaataggtaaactgcgtgatttccataccgtccaaccaaacttcccagcccagaccagctgagcctgttgaagggttttcccagttatcctcaacgaaacgaatgtcatgttccaaaggattgatacccaaacgctccaaagattccaagtaaagttcttggatattagatggagatggtttcataaccacttggaattggtggtgctgatacaagcggtttgggttttccccataacgaccatctgctggacgacgtgaaggctctacataagccgcattccaaggctcaggcccgatagcacgcaagaaagtgtatggactcatagtacccgcacctttttctgtatcataagcctgcatgagcaagcacccctgctcattccaaaattgttgtaaggtcaggataatttcctggaaagtaagtttttttgacatatttttccttctttctttaaatctaagtcttttagtttacttttagtactaggcaacaagctgcaggcagtactgaggtacggcaaagcgagttaacgacgtaataaaagataaactaaatgacgatgtttttgcgacgtgagccttcctagccgataccgctaggaaaggcgaactagtacagcgtctagctcagccgccatagcgatgagcgtgtggcaattcgactgaaaggagactatgccactggcgctgtgaaaagtaagtttctttgacataacagcctctttctatatatattgcaaaatggctagttctccacactcggtatagtttccacaaagacagcctgttctgccttgtccatataggaacaggtcatggcttctagatcgatgacccacttgtaaatccctgcttctgctgtttcttggcagaaggtgagaaaatctgtttgtccagcctgatgattgcgtaagatagtcacaaactggtccagattggcttggtccgaaacaggtatcgtcacttgatagccctgcttttccagagtttgccctgtctgtgagcgataggtaacctggccagactggatatccacaatattttccaccatacccaagtccttaaaataggcaatcagtttgggaaaatcaggccctgtaaactgttcatgcccgtgattgatattttctaaggtgaacattggtctcctttctttataatagctgtctttcaccttgagatgaaaaacaagaaatactcggtcggcagacaaaaagaaccgcattctcttcccctgtcaacagacataggggcgttgagaacgcggttccaccctaatttattacttcatttgtatgattctgattgagtcggacatggtcacgactgggaaagcgccaattatttcaagactggcttggctttcactctcccaagctcgctagacaggcttttgaaacaaccttctttcatgcttagtattgtagcagaaaaatcagcatttgtctagaaagaccactatttatccgaacacaatcccgctgacaaatcctacaaggctattgcaggcctatcgcaatctagtagatatttttctggtactactcccaagaatttttctgcgtgttgactgataaaatctagggcattttccaaatcttctactctatcagaattgaccaactccatgaccaagaaagcattctttgtctcatccgtaatcatggttcgctcaccatcgcgccaattgaaacagcgacaaacggcgcctttatcatccttatagcaaacttcacctggtaaagttggattattggtttcatcaccaatgagatagaattcatccccaccctcagtgaccgttagttggagattgcctacaaatgtatctaaatcttcagcaccacatggaagaccaaaacgtaaactcgccgcattataaatgtccactaatggagaaattgttgtgactggacggtcactagttgaacgtttcaaaagtgcttcgatactagaacgcgcgcctttttttgttttaaatttttgataggcttgacgatatgtacgaatgacctcattctcactaaaggtatcttccgtaagaaatttctgggcaattccgttgctttcttccagtaatttcactaattcatcaggcgattgcgccggcgttttataatctttcaataatagaactccaatttttgcatctggaaatagactccaaaaagatgaatcaacaacaaattgtgacatattctcactccttttatagaaaaatcagcaccctatgaacatcttctaagacctaacgacgttcataaaatgctgttgcatgactacccggtggcagtgtttatttaattaaatttattgtataaaaatgctttaaataagtcaaggactatccaaaatttgaaaaaacacaactaaataactatctatgactaatctttctcgtcaagaaatctccaataaactggattacgaagatgataactaaaatcaaaagagttgctaaaaaggtcacatcattattataccgtaggtagccgtatgatagcgcaacctgtcccaaaccacctgctccgatagctcctgccatggctgtatagccgaccaaggaaaccagggcaaatgtcgtcacacgaatcaagtcaggcagaccctcacgcagatagacaaggacaatatcccagaaagtcgcacctgatgcctgagccgcctcaatgacaccacgatccaattctgataaaaccacttcaacctgacgggcaaagaacggaaagactgaaagagcgagcggcaccaaagccgcctctgtaccaatggtttttccaacaataattttcgtcaaaggagcaatagccgccaacaagataataaaaggaatggcacggaagatagaagccaccttgtccaaaatccaataggcagtcttattggcaataaccccacgtggacctgtcaagaccaagaacaaaccagacaccaagcccataaatccaccaaaagcaaaggaaacaaaggtcatatagagggtcaaattaaaatgtgttaaccaacctgtctgaccatcccagcccaatttataaatatctggaaaattcgtttgaatccattctaacatctagttcgctcctttcaaaatcgtcacttccacacgcgcttccgtcactgcttcaatcgcacggtgcaactgaccaggttcacctgataagatcaccaccatctcaccgactggcgtatggtccaaaatttcaatattgccataaagaatattggcagatacttgatagaatttatacaagtcattcacaattgccgtatccgtatttgaacctgcgtacttgagttgcaccaaaatactgttctcaggcaaattcttaacaatatcctgctggtaaattttcaccaaggcctcatcaattcctgttgctgttttgatgaaatcctgtgtcaattcttcttttggatgagagaagatttctaaaactgaaccttcttcgatcaagcgaccatcctgcataacagccacacggttacaaatatcttttacaatctgcatctcatgagtaatcataacaatggtcaagcccaatttttcattcaattcctgcaaaagtgccaaaatctgcttagttgttttcggatccaaggcagaagttgactcatctgaaatcaagattttagggtcattggccaaggcacgggcaatggcaacacgttgtttttgaccaccagacaactgagctggatagttttcagcacggtcagaaagcccaaccaagtccaacaacttagcaactttttctttcttctcttccttgctcaaacccgaatgcttaagggcaaaggctacgttttcttctgccgtcatttgagccatcagattgaaatgctggaaaatcatgccgatttcacggcgtttgctccgcaattgagctggggtaagtgtgaccttttctccctcgtaaattacatcctcatcgatagtaattttacccgctgtcggcacctgcaataaattaatcactcgaacaagggtagatttccctgctccagaataacctacgataccgtaaatatccccttgattgatatggatggtcacatcctttaccgcttcaatcgtacgttttttctgctggaaagttacatcaatattatctagcttaatcatttccttactcataacttgcaattaactcctctactaattcaacatggctatagtagtcagcgatgctgacattttcatcacctgcatggtcgcgactgttggcatttcctaatccaaatcctgcaatcggcacgcccaaggcatgaaaaactgtatgcatgggtcctgtccccggtgacgtcggcaaaacagcaactccttctggcgtcaactttttagccaactcaatcacattgacaatggcagggtgggacatgtcacttcggtagctcatctctcctagagtgaagacaacctcaactttgtcaaaaccatgtttatccaaatgctggcgaatcttatctaatacatcatgcggctccaatccaggtaccagacggacttccatcttagcagaagcctgagctggtatgatggtcttgacaccttgaccaagatagccagttgacaagccttgaatggtaatcgatggttcaaaatacaaacgcttcagaaactcacgacgatcttctatcaaggttggaagggttagtccataaatatccgtcatagactgactggtagccagtgcaaattcttccaccaaggccaattcacgctcatttggctcttgaacctgatcgtaaatgccttctaccagaatttgcccatctgcagcccgcatggattgaagtgctgataataaataccagcttgccgaatcaatgacaccaccataggaagaatgaatatccaagtcagctgatttgacctgaagatcgaaggtcacaattcccttattcccaccagcaatttctagctgatgtaggctattgcgatgcccctgctcccagacaagcaaatcagcaccaatcaaatgttctttatattttgaaagatacttatccaagtcgacagaggctgactcttctgccccttccataataaaaatcacattgactggtaaatggccattctgtctagcttgatattttttcaaggccgacagacgagctgtgatatggcccttatcatcatctaccccgcgaccatagatatagccatcggaaatggtcaattcgaaggggttgcccttctcccagacctgatcggcatctgcaggtactgtatcataatgattgtagaaaatcaatgttttcgcatctggaaccgaagcctcaaacctagccatgacaaagggtgctgcataactatcatccaaaacaacctctgcaccagcttcttcaaatatatctttcaagtaagtcgccacatccagcaaaccaatctgctgagcaaaaatggatttctttgaaatcaagaccttcaacttttcaaaataggtttgaataatcgcatcattttcaaatgcttgaactttactatctgccatactttctcctcatactcaatgaaaaccaattaaatctactaaccaaaatcaaatattctcccacatttctgactttggttaagagattttttcttatctctataaaaacagatagagggctgaacaattctgcccagtcctcaacctatttacattttaccaaactggctcatccataccgtctgaagtctcttcaataacttttttcacttcatccgtgtggtaggcttcgataattttcttaatcgctgctgcttgctctgatttttcccaatcgctacgagctgcaatcaagttgtaccactgttttgaattttcatctttttgctctttgtaaagggcatttttgtaatccaaaccagcttccaacacaaatgtgttgtttacaactgctgcatcaactgagctaagtgagcttgctgtttggcttgcatccaactcagtgatcttcaagtttttcttgttttcagtaatgtcagcaatagttgccaattctgtaccagatacaccaaccttgatcaaaccagctgcttgaagaaggtagagagcacgactttcgtttgttgggtcgtttggaaccgcaatttctgcaccatctggaatttcttccactttagtgtacttgttttttccatcagctgtacctgagtaaagacggattggtgcgatataagtatccgcaatagcaaccaagtcttcaccattttcttgattccagttattcaagaagttatagtgctggaaggcgttgatgtctacttcgttttcagctactgccttgtttggctgtgagtaatctgtaaattgagtgaactccaatttcacttcatcaccaagaatttcttgaactttatcccaacgggcttgctcagaatcgctcaagctcatcacacctactcgaacagttgttgcagatgaatctgaacttgaagaagagttaccacatgcagcaagtacacctactgataaagcagccgttgccaaactaaacaatttttttaatttcataaaatgatctccttaaattaactgtatctatcttaacacagaattttctttctgactaattgactttttttatagaaagttataacttttcgttataacaaatacccttgcaattataagtattgataataaaaagagggatacccctcttaaaatatatctactaaatactgaaataggtctcgatgttgcttacaatcattgtataaaaattctggatgccattggataccaaacaaagcttggttccctctactttcataagcttctatcgtaccatctctaggatccaaacctgtcgccaccagtcctggagccaattctttgattcgttgctgatggaaggaattaatagggctcccttgggcaaacaattgaccgattcggcttttaggtttcacttgtaaacgatgggatgtcccagcaataccatcttgccaatgatgatccacctcttgttccaagcttccacctagagcaacattcagcaactgcatccctcggcagactgcaaaaatcggttttccctgatgaagggcttcctcaatcaaagccagttcaaattcatcccgttccaagaggtaatcattactatcaatcaagcgtttttgaccgtagagacttggatccacatgctgaccacctgacaagatcaacttgtcaatcatatcgatataatccttggctaagtcaggagttcccataggaataaccattggtacaccaccagcctgacgaacgctgtctgccaattcacgcgctaccgttacatatacgcgaccagattttgttggaaattcttgctcgtttcctgaaattccaatgataacttttcccataaaaagcccctttctttcattttttcaattgtagcatggctatctagccctgtctaatatagaagttttatggcttgataaaaaataactatcagaactacctataaacaattgctcataaacaagagtttgcctttagcagtttcatagataaaatctataccacgcttaagaaaaaactatactggagccagcataaaaaagtcaagcttgataaacaggctttttttcaagcttttatatagaagaaatatcaaaaaagtagctctctttcaatctgttatagtcaaaagttataactccctctaattttttacaattatacaagagtcgttttttctgttaggataggggcatagaaatattttggaggaaaaaccatgactactactattatcggcttcccacgtatcggagaacaccgtgagttaaaatttatcactgaaaaatactttagaaatgaaattccacaagaagagcttttggaagcagctaaagacttacgtgctaagcactggaatattgttaaagaagcaggcattactgaaatcccaagcaacgacttctcacactatgacaatgttttggatgcggcagtactcttcaacatcatacccaaagctgttcaagaccttgaattaacagaccttgaaaaatacttcgctcttgcacgtggttatcaaggagaaaaaggggacgttcgtgctagaccgatgaaaaaatggttcaacaccaactaccactatatcgttccagctattgaaaaagatacagaaatcaaactagccggtcataagattttcgatgaattccaagaagcaaagaacttgggcatcacaactcgtccagttttgattggtccattcacactcttacaattaactgattttgaagaaggtttaactgctactaatttcgctgatagcttagttgcagcctacggacaagtctttgaaaaattagcagagcttggtgctgaaaaaatccagctggacgaacctagcttggtcaaggatttgactgctgaagaaaaagcccttttcctacgtatctaccaaacactcttggcagataagaaaggtttgcaagttctcatccaaacctacttcggtgatgttcgtgatatttacacagaattgaccagcctaccagttgatgccatcggtcttgactttgtagaaggcaaggaaacggctgcacttgttgcaactggtttccctgctgacaagaccctctacgctggtatcgtcaacggtaaaaatatctggcgcaacaactacgaaaagagcctggctgttttggatgctattccagctgaaaatgtcgttataacaacttcttgctcccttcttcatgtacctttcacaacagcaaatgaagaatttgaaccagctatcctcaaccactttgcctttgcagttgaaaaactgagcgaattgcgtgatttggatgccatccgtaacggtcaaggcgaagttgctctcacagctaacaaggaactctttgcccttgagcgtgttggtcgtgatgcagcccttgcagaccgtcttgcaggactgacagacactgactatacacgcctaccagtctttgcagagcgtgaatccattcaacgcgagaagctaaacttaccacttcttccaacaaccactatcggttccttccctcaaaccaaggaagtccgtagcacacgcttggcctttcgcaaaggaaacatctcagaagaagaatacgatgcatttgtcaaaactcaaacagatgagtggattgcatggcaagaagaagttgacttcgacgtacttgtacacggtgaattcgagcgtaacgacatggtagaatacttcggtgaaaacctgtctggctacctcttcagtaaaaacggttgggtacaatcctacggtatgcgtggagttaaaccaccaattatctggggtgatgtaacacgcttgaacccaattactgtcaaatggtctagctatgctcaaagccgtaccaacaaaccagttaaaggtatgttgacaggtcctgtaaccatcctcaactggtcattcccacgcgaagatatttctatcaaagaatcaacccttcaaattgctcttgctatcaaggaagaagttcttgaccttgaagcagcgggtatcaagattatccaaatcgacgaagcagcccttcgtgaaaaactaccactccgtcgtagcgactggtacagcgagtatcttgattgggcaatccctgccttccgtttagtacactcaactgttgcaccagatacacaaattcacacccacatgtgctatagcgaatttactgacatcattcctgccatcgacaatatggatgcggacgttatctcctttgaagccagccgttcaaatcttgttatcctagatgaacttaaggctaagaacttccaaactcaggtaggtcctggtgtctatgacatccactcgccacgtgtccctgccgttgatgaaattgcacacactattcaagccatccttgctaaagtaccgaaagaaaaagtttggattaacccagactgcggactcaagactcgtggcgaatcagaaacaaaagctagtcttatccacttgactcaagcagctaaggcagccagaaaggaactctaatttatgattggtcaaaccccaagtctctcatttgaaatttttcctccaaaaccagcagtaggcaatgaaaagattatccaaactctcgatgagatgcaaggtttggcccctcattttatcagtgttacatgcagcaataacaatttgaacgtagaagagactactgtcaagttggctaaccatgttcgcaatgaattgcatattccaactatcgcacatttgccagctgcttacttgacaaaagaaaaggtccgatccgttcttcattctctcgatgaaattggtgtacatcagattttagcacttcgtggcgatattattgaaggtcttccccctaaagaggactttcagtatgcaactgacttgatttcctttatcaaggaagaagccccacattttgacattattggagcctgttatccagaagtacatccagaatcaccaaattctgtctcagacatcaaaaatttgaaaaagaaagttgatgccggttgctcaaccttggtaactcaactcttcttcgataacgaagcattttataactttcaggagaaatgttctctagcagacatcgaagtgcctattatcgcaggtattatgcctattatcaacaagaatcaggcacttcgactcttgaaaacctgtgagaatatccgcctccctcgtaaattcaaggccatcttggaaaaatacgagcacaatcctgaatctcttcgggcagcaggtctggcctatgctgtagatcaaattgttgacttagtgaccaatgatgtggctggtatccatctctacactatgaacaacgctgaaacagcacgcaccatccatcaggcaactcattcgctattcaaacattatagttagaaaactccccctgagcccaagctcaggggttattctatgccctgtgactcccaaagactacatgataaatttttcaccccatcatgacattaatccagcggatgtctaggtatgagacatcttgcttacaataacgaacagccatttaaaatacagtcacaaggagtaaaaatggcactaagaggagacagagaagcgacgaaatggaaaaataaactccatccgttttcaatttacaatcttcaatacagcattatgctgaataaatcacattgattcccatatattttaatcgtaaataaaaaaactgaccttcaaatgaagatcagttcaaggataataaacagattacaagatggctagaatgatgaaattcagaataaatagagctgtggcaccccaaaggattggatgaatttctttagccttacctgtcgaaacttttaccaagcaatagaagataaaggcggctgcaataccgtaagagatagagaagcaaagcgccatgaagaaggcggcaaagaaggctggaagcgcatcttcaaagtggctccaatcaacatcaaggaaggatgaaaccatcatgacaccgatgataatcaaggctggagctgttgcagcatttggcacaattccaatgaatggtaaaatcaaaattgatagcaagaagagaacggcagttgtaacagctgtcagaccagtacgaccacctgcagagatacctgcagccgattcaacatatgtcgttgtatttgacgtaccaaatagtgcaccgatagaggtaccaatcgcatctgcaaagagcgccttgtccatcttagagttaaagcctgtaccattttcgagagctttttcatcttcttctgagaaaataccagtcttacgacctgtaccgataaaggtaccaagtgtatcaaaggtatctgacaagctgaatgcaaagatagtcatcaaaacaagtggtagacggcttgagtcagcaaagagcgaagatagaccatcaaaagccgctaggaaagttgtaccaagctccgcaaaggctgtaccggtattgttatttgcaaaatcgattgtagacagatccacaacacctgctggaattccagctacagtcgttgcaataataccaatcaaaattgcaccacgcacgttcttaataaccaaaacagctgtcaaaagaagaccgaacactgtcaagagaacacttggatcagtaaaggttgaaataccaggtacgacaccaccaccagcaaaaactgagaaaacaccgtttgagaatgtttctgctgttgcatctgccggagcaacaccatttacagtaataatatctgaaccagatgtcaagaaggtgattaaattagagtttttaaaaccaagataggcaacgaatacaccgataccaccaccgatggcatgttgtaaactaactggaatcgccttgataatactcttacgaacctttgtaactgtgataaaaacgttaaacaaaccgcagaggaaaaccattgccaaagcttcttgccaagtaaaaccaagaccaataaccactgtataggtaaagaaggcattcaaccccatacctggtgccaaggcgtaaggtacgttagcaaataatcccataacaagcgttgatacagcactggcaattattgtagccaagaaaacagcctgtgttggcatacctgccacactcaatacgctcgggttaacgaacaaaatataggacatggcaaagaaagtcgtaagtcctgccataatttccgtagaaacagtcgttccatgttctttcaatttaaaaaattgatccattttttcatctctccttttaatttacgaacaataaaaacattataatcaaaaaacattataatttcaagttttttaatcttgaaaacgttattttattaattttcaactttaaacattcgtaaattccgaacgttgcaatcttgcaaaaatctatacaaaattacttgcttctttgcttttattatctccttttgttatactggaagttattagttcaagatgtggctacctacaagtactattctttgacgcataaaacaatttctcagcactctaactactacctaaacattattcactattaaaaactagtataacaactctagaaaggaatgctattaaatatgaagaaaaaaatcatagctatcgatttggacggcacattgctcaataatgatagccaattatctgattataccatctcaactataaagaaggtccgccaagcaggacacaccgttcttatcgccacaggtcgcccctatcgaatggctgaaaaattttaccaacaactagaactggatactcccatgattaatttcaacggttctttagttcacatccctggaaagaaatggcaatgggaacaaaatattttaatcgacaaaaaatacctactcgaatttctaaaagaagaagaaacattcgaggcagattttattgctggtgaatacaagaataaattctacatcactcaaaagaacttagacaagattgatcctgctctgatgggagttgaacagattactcctgatacactcatcaaacctgaattaatcactagtgatcctcattccatccttatgcagactcgtgcaactgataagtatgaacttgcaaaagaaatgaatgcctatttcaaagatgaattagaaatcaatacgtggggcggaccattaaatatcctcgaaacttgtgcaaaaggcgtcaataaggcaaccgctctgagctatgttcttaacctctaccaagcctctcctagcgacttaattgccttcggcgatgagcacaacgatgttgagatgctagacctagcaggaacagcctatgccatgaaaaattgtagcgatacacttcgtccgcatgccgacagattgacagcatttgctaattttgaagatggtgtcgcacgtgaactagaaaacctatttttatagacatcaaaaaacctgataaactatcaggtttttgtcatattcgttgcatatttttatcacttttctgaaacacgattatcaaaagtttcggaaatattttgcacttttaacacaaacctacttgacaaatgtactgaaaacgttttataatggtaccgttcgaacatgaaagcccattcaatggtttttacatgaacaagaaaaatttaggaggatcaataatgagtattggaatcattattgcaagtcatggcgaatttgctgctggtattcatcagtcaggttcaatgatctttggcgaacaagaaaaagtacaagttgttacttttatgccaagtgaaggtccagatgatttatacgctaagctaaatgctgccgtggacgcattcgatgccgatgatgaagttttggttttggctgacctttggagtggttcaccattcaaccaagcaagccgtgtagctggtgaaaatccagatcgtaagtttgctatcatcaccggtctaaacttgccaatgcttatccaagcttacacagagcgtatgattaacgctgctgctggcgtggaagaagttgcggcaaacattatcaaggaagccaaagatggtatcaaagttcttccagaagaacttcaaccagctgaagctgctcctgttgccgatgctgctcctgttgcactacaaggtgctatccctccaggtactgttatcggtgatggcaagttgaaaatcaacttagcccgtatcgacactcgtctcttgcacggtcaagtggcgactggttggactcctgcttccaaagcagatcgtatcatcgttgcatcagatacagttgccaaagatgaattgcgcaaacaactcatcaaacaagctgcacctggtaacgtaaaagcgaacgttgtcccaatcaagaaattgattgaggtttctaaagaccctcgattcggtaacacacacgccttgattcttttcgaaactcctcaagaagctcttgaagcaattgaaggtggtgttgaaatcaaagaattgaacgttggttctatggctcactcaactggtaaaacaatggttaacaacgtattgtcaatggacaaagatgacgttgcaacctttgaaaaattgcgtgaccttggcgttgaatttgatgtgcgtaaagtaccaaacgattcgaagaaagacttgtttgaacttatcaacaaggcaaacgttcaataaatcgatctgttagtatagaaaggattacaacatgtcagatattacacttatttctgcaattctcgttgtcatcgttgccttcttcgctggtcttgaaggtatccttgacgaattccaattccatcaaccattggtagcttgtacccttatcggtcttgtgactggtaacttggctgcaggtgttatgcttggtggttctctacaaatgattgcacttggttgggcaaacattggtgcagctgttgcacctgacgctgctcttgcttctgtagctgctgcaatcatcatgatcaaaggtggcgacttctcaactgaaggtattgccgttgcaacaacaactgctatccctcttgccgtagctggtcttttccttacaatgatcgttcgtactatctcagtcggtcttgtacacggtgctgacaatgctgctaaagatgcaaacttcgctgctgtagaacgttaccacttgtttgctcttctccttcaaggtttgcgtatcgcagttcctgcggctcttcttcttgcaattcctgcagaagctgttcaagcagttcttgaatctatgccagcttggttgtcaggtggtatggccgttggtggtggtatggttgttgccgtaggttatgctatggttatcaacatgatggcaactcgtgaagtatggccattcttcgcacttggttttgcatttgctgctatcagcaaattgacacttatcgcacttggtgttatcggtgttgcaatcgctcttatctacctcaacttgtcaaaacaaggcggatcaggtaacggtggtgcttcatctaacgacccaatcggcgacatccttgaagactactaagagaagggagattcatcatgtcagaaaaaattcaactttccgtaagcgatcgtaaaaaagtttggtggcgttcaaccttccttcaaggttcatggaactatgagcgtatgcaaaacttaggttgggcttatgcaatgatcccagctatcaaaaaactttacactaaaaaagaagatcaagctgctgctcttgagcgccacttggaattcttcaacacacacccatacgttgcttcaccaatccttggtgtaactcttgcccttgaagaagagcgtgctaatggtgctgaaatcgatgacacagctatccaaggtgtgaaaatcggtatgatgggacctcttgctggtatcggtgacccagtcttctggtttactgttcgtccaatccttggtgctcttggtgcttcacttgcactatctggaaatatcatgggaccaatcatcttcttccttggctggaacatcattcgtatggccttcctatggtatacacaagaatttggttacaaagctggtagcgaaatcactaaagacatgtctggtggtatccttcaagacatcactaaaggtgcttcaatccttggtatgttcatccttgccgttcttgttcaacgttgggtatctattactttcgctgtagatcttcctgctaaacaattgtcagaaggtgcttacatcgtcttcccagaaggtactgttactggtgctgagttgaaaggtattcttggtcaagctcttagcggacttagccttgaaccaactcaagctcaaacattacaaggtcagttggacagcttgattcctggtttgatgggacttctccttactttcctctgcatgcacttgcttaagaagaaagtaacaccaatcacaatgattatcggtctcttcatcgtaggtattcttgctcgtttcttcggaattatgtaatcaaggaccccgctcttgcggggttttatgatataatgaatatctagggagagagcactatggcacaatcacaaaatacaagcgttgaactacaaaccacaggggtttcctacatgggctttggtggcaaggttggtaaatttctaattggtgacaaggcacttgaattctacccagatagcaacgttgaacgctatatccagattccttggtcagaaatgactagcattggcgcaaacgtttctggcaaagcaatcagccgtcattttgaaatttatacagagaaaagtcgattcttgtttgcatctaaagattctggtaagattcttaaaattgcccgtgagcatatcggcaatgaaaaagttgtgaaattaccgactcttatgcaaacaatcggcagaaaaatttcgaatctatttgccaaaaaataaaaattcaagtataatagtagaaacggataagtagcatctggctccttccagaaagtctgcggtcgctgtgagcagataggaaaaagttgtgaaattctaccgttatgaaattatcaaaatacaatcaagtgcacagaatgtgaagctggatggaaccgcggtaaatatcgctccagcatctctcattctgtgcttttttattctaaaggagacatctatgctagatatcaaacgtattcgtactgattttgacggagtggctgccaaattagctactcgtggtgtggctgctgaaaccttggcaaacatcaaggaattggatgcaaaacgccgtgaaatcttggttactgtagaagaattaaaagcagagcgcaacaccgtttctgcggagattgcccaagcaaaacgcaataaggaaaacgctgacgacaagattgctgccatgcagaaactgtctgcggatgtgaaaaacttagacgctcagcttttggaaatcgatgaagaattaaacgccatcatcaccgttcttccaaatacgccgcacgattctgttccagttggtgcggatgaagaagaaaacgtagaggttcgccgttggggaacacctcgtgaattcactttcgagccaaaagctcactgggatttgggcgaagacctagatattctggactgggaacgtggcgcaaaagtaactggtgcacgcttcctcttctacaagaacttgggtgctcgcttagaacgtgccctctacaacttcatgttggacgagcatatcgcagaaggctaccaagaaatcatcacgccttacatggtcaaccacgactctatgtttggtactggtcaatatcctaagttcaaggaagatacttttgagttggcagacactaacttcgtcctcatcccaactgcggaagtgccgttgaccaactactaccgcaacgagattctggaagaaaaagacctgccaatctacttcacagccatgagcccatctttccgttctgaagctggttctgccggtcgtgacacccgtggtcttatccgccttcaccaattccacaaggttgaaatggtcaaatttgccacaccagaacagtcttatgatgaattggaaaaaatgacagcaaacgcagagaatattctccaaaaactaggcttgccttaccgcgttttggccctctgtacaggcgatatgggcttctcagctgctaagacctatgacttggaagtctggattcctgcccaaaatgcctaccgtgaaatttcaagctgttccaacacagaagatttccaagctcgtcgcgcccaaatccgctaccgcgatgctgctgacggtaaagtcaaattgctccacaccctcaacggttctggtctagcggttggtcgtacagtggctgccatccttgaaaactatcaaaatgaagacggttctgtcaccattccagaagttctccgtccatacatgggtggggtagaagtgattaaaccttaagccatacaaagaaagagcgaggaaaaatcctactcgctcttttcatttatctaaaaatctactcccaaagtctttaattgttgacgaatcttatcttctagagcccgaatctctagtctatcttgttctagttgctgcgttacttgcccgagatcaatctcttcctcttcctcaaaagtatcgacgtaacgaggaatatttagattgtagtcgttttctacaatttcttctattgatgccaaatgagcatatttgtcaacagactgacgattgtgataggtctctacaattttttctaccatgtcatcggaaaggtgattctgattcttccctttctcaaactccttgctcgcatcgataaagaagacatccttggtctgacgattttttttgaagactagaatagtggttggaatgcctgtgccataaaacaggttagctggcaagccaataactgcatccaggtaatttttctcaataatcagtttgcgaatatgaccttctgctgctcccctaaagagcactccgtgtggtaaaacaatggccatggtccctgtattattcagatgataaagactgtgtaagataaaggcaaagtccgctttagaagctggtgctaacttaccgtattccataaaccgtggatccttcaatttggactcacgattgtcccatttagcagagtagggtgggtttgcaacaaccgcatcaaaactacgtggctgatcgattccaagttcatccaccccgtccggccagtcactttctaaggtatcagcattattcaaaatcatattgctgtagccgacctgatgcatcatcaggttcatccgcgccaagttataagtagttgtgttcatttcttggccatagaatttgatatgctggccctgaggtagttcattacgcactgttagtagcaaagaccctgaacccatggttggatcgtaaacagagaagctagtatctgatttttccaaacctaaagtaacaatcttggctaaaatcttactcacttgatgcggggtataaaattctccaccttttttacctgccgaagcggcaaactgtccaataagatactcatagatttctcccagaatatcctttccttcgtcatttttatactcaatgctatcaatcaacttcacaatactgttcaaggattttgcacgcacaaccgttgaattgcccaaacgagagtcccctagattgatgtcattaaagacgcctctgaaatcttccatagcatcccgattgagttctacattggcgttaaaatgatcgaaaatcgtctggtagtcactcgctacaatctcactgttatcaattttggctaccagtcttgcccaggtatcttcaggctcgatggcatacccaaggtgagaagctgtattttccaaatgctctaccaagtcattcccaactgcttctcgcgcataggcatcctgaacagtttctcctggagcaggactgataatttcatcttccaccaagaaacgctcttgatgctcagatagatagcgatagaacatgaaggctaggatatagttcttatattccgaagcatccatatttcctcgcaattcattggccatggaccaaatctgattagtaatggcctgaatagtttttgacatgtttttgtaatcctttcatgttgtttcattttttactcgaaatctcattttcgctgatgaagagtaataagctgatctaggtcggaaaagaagctaccgatggcttcttgttcagggagggtggggagggagataggcatgccaagaaaagtttctgtgtggattcttttagcttttctagagccatttgcaatatttccttgataataataaaattctttgcgagatacaaattctaacagaaattgcccgtttatccctttcaataaatcaaaagcaggcgaatcaagagttgattcataaccatcaagttctggtggaataattccaaaagcttgatttaaaaagtctaatttcccatatataaactggcctgattttcttatataatactgtgtagctgaactaccactataaatttctttcttggaaacaactcctctcccccataatcttacagttaacttccttgctatatctcctttactacctaaaattttactttctttcataaactcccccaacttacgctgtttccaagcgtccgtaaattctgggaatcttagctcaggaaaatcgtttccattccctttcggaaacattttctgtaacaaagccttcttcaattctttaacatcatctaattttcgctgatgaagagtaataagctgatctaggtcggagaagaagctgccgatggcttcttgttcagggagggtggggaacactactgtcgtggattttaaattagccttactaattgagctcacttttgtcccctgcattaaaggtaaaatttgattatggtatgcagttgaattaattagataacctaaatagtagggggcataagaaactttcggcctagcaactatcgtatgtaaaccagaaacaacattcttacccttaaaatttcgaacttcaatagctttcccaacagtcgagtcttctgccgcatccgcgaaaacaatatctccttcactaagtaaagcatctgcaaagtctgaaatcgtacttccaataattgatggaagttctttgttacatacatctaaaatagcatcatattttgttaaaatatccccataatgaatgttctgaacttcataaaaatacgatgataacttatctctagaaagtgagtttgtttttatggaaaagtccgccacctcccccaacttacgctgtttccaagcgtccgtgaatccggggaagcgcaatcgtggtacggttgatttttcttttgtcatagtccctccttttctactctctttttgttctatttctgaaagttatttttgcaatttttcggacgatttccattctattatacgctatcatccaacaaaatcgcaacctattgaccaaccaagtcgtcggccaaatcatatagtgcttgtctcaactgattgcggtactgaatcttgctcaagcctttaacagcatcaccttctgcccaggtctggtaatcgcgactagcttcttttatcaaggtacgtaagtgtccggtatcatccaagtcattctgaccatatcgatgtctcgtcaacaactctcgtagttcttggttgcggatatgttccgtcaagccccattggattcggaaagcaaagagcttcttgtcaatgtaaacatgcgaagcttcttggataatcttctgactatcaatccccttgactggataagcaaagttcatatcttgtgtcggaaaatcacctcgatagattgcatcccctgtttgacggatctgatcagcatagttgaggtcttccaaaccgcttgcaaatctatccaattcatccctggtagctgcggcttctaccatcttctcttcgtgaacctgattcagcaagagctcaaccagttcggtcaatttatcgtagtcaattgtcacttccttgatgtgagtcatcttgagttcaatttggtgaatgctaactttttgctctttcgccaaggttcgtttcaattcgttggctaagaccgtcgtcaaaagtttttcttcctctacagacattcccaaactttcaataaagcggtccggctgattgtaatcaaatccttcaatcaccccatcaacctcctctggctgatactgtttgagcttagacagtccttgattgtaagcacggagcaattctaacatagcctcacgctttttctcagacttcggaatatcattgaaatcacccgtcaactctctcaattggtcgaccgtttgtttgacttcagcaaatacttccttgaaaggcttagccaccagtccatttttttcattgttatttttttgttccgcatctgataaattagcagcactatcatctgcatagatggccaaggcctgattcatcaatttctcattatgagctggccagcggtaattgaccacccgtccaaaaggttttttatccatatcctccacacgattggtacgagaataggcctgaataagactggctcctttaagggttcggtcaacataaagagtattgagctcaggagcattgaaacctgtcaataactgatccacgacaatcaccaaatctaagtagttcttgtcctgagctgttctattgaggcgactaatcaggtcctctgtatacgcagcaacatctgacaagccaaaggacgtcccaaattctgtgttatagatcgtaatagcttcaagcaaaccagtatttgactcgaccatgctatcattattttgagtattcaaggcaaaggtcaatcccaccttcaagaccagacctccttgctctcgatgtagttgattgattcgttgaaactctcggaaatacatcatagccatgggtgtggaggccctgcctccacctacgtgggtggtgaacaaggcattgtaacgaccactgccagagcgatttgcccagtgtttgaagacatcttcgactaccaatcgaacatgctctggattttcatcatagacgctagaagtcaccgcatcatccatatcatctggacttagattggcaattttttcttcaatctgtgcacttgtccacttcgggtatttttgccgataaaaatctggtaagtaagttgtttttagtttttcctgatcgatggttgtctcaaaatctaccttaaaccctagtacattgcggtcactaatggcatttttaatagtgtaggcatgaagaagagggccaaaaatatcttgcgtctgcagactagcacctgtatcatctaagttgggagttcctgtatagccaatccaagccgctttcttaaaggccttttgaatccctgcaaaactatctccaccagttgagcgatgagcttcgtcaacgataaacacgatatgcttatctggtgatttgaaggattttctcttcaccagtgtatccaatttttgcacagaagtaacgataatcccactatccttactagtcaactgccgtgccaaggctgtggtattttgagtttctcgaatactgccaaaactattctccccagcttctggatcataagccagataatcatccttagtctgattggtcaatgcgatacgatccactagaaagacaaccttgtctaccttgggcattcgacttgccagccaagctgttttaaaactagtgatcgtcttccctgagcctgtcgtatgccagatgtagccaaccttgttacagcctagttcaaaatcgactttttttatcccctcaatgaccgcatgagtggcgtaaacttgatagggacgcatgactttcagcatttgtttctgcggtgtcccgtctaagatcatgtagttggtcgccatctgatgggccataggaatgctgagcatggaatccgcaaagtctttccaattccgaaccttactaccgtcagatttacgctgccagtggaaagcaaagtccttattaaatttttccgcagtggtattggccatatagcgaacattgttgggggcgatagcgactagaatctgcaaggtagaaaaaatatccgtatattgccgttcctggatatattggtgcatttggttcaatgccttgtccacatctaccgtatcctttttctcttcaatctgaataataggtaagccattaatcaacaaggttgtatcgaatatacattctcgtcgtccagggattttaggagtcctacgaatttggttcaccacttggtagacagtgtccccaccgcctatcttacgttggtcgaatactgtcaaaaatgtatgccgtccatcatcaagcgtaatttccaattcggaaacaccgctaattccatataaaaactggccagcctcataaggtgtcttcagatctgaaataatctgcttgacttgagcaaactcggtatcgctcaagggtttgtccaatcgatgttggttgtgttgccagagaatattacgaaaattttcccataattgctccgttgtcttgatacccggctcataagtccacagtttagatttgactgcatacaaggtcgaagaatcactaacagaccattctaaaccttctaggtgctccggttgtgtaatagtccctgtcgtaatatactgaatcaattctgtttcaaatgctaattcattcatgtgagtaaacctcctttaacaaatatgttagtcgtaaaaaatctccttgcgcataagcttgccgcttctgccgtaaggctaatccatctaaataaatctttcctagtttctgctgactatctaaaggaggcaaggcacctagctgtaaacttttcagttgcttgactgtatatttcattacctcactcccctgtaagctttggtaaaactgccgtctaatagccgaggattcattgatcagatacagtaagaaggccttatccagctttgcaatgggctcaattttgatatagttctgtgtatagagtaagcctgcgtgctccgctctcactaaaacagccttccccgatagtaaactaaagagtaagtctccctcctcgagcaaggtcacttctctatctgtcgtcacggtccgactatctatcacttcttcttctatcacctcataaccatccaattgatgatgttgctgattgtagaggatatagtctctagcatcttcccagctagtagtatccaagcgaacctgtaaactacctcccataaagagagccaattcttctagtttcataatttccctttctttgaaatttttcataattacattttttgataaactaagtatagcatcttctcagaaacctgtcaataaattatgtaatttacaaaaattaaaaaaggaggttctgccatgaacttatcaaaagaaaaattgcttttccatcactattatgcaaattggcttcggatttacaaggaaggagccattcgagaagtcactctcaagaaatatagaatgacattgcagtggcttatcaggctagctcctagtctgttgttggaagatttgaatcgggttcgttaccaagaattgattaacagctatgctaaaacacatgaacgacagacaaccatggattttcatcaccagttgaaaggagctattttagatgctgtagatgaaggaattattgaacgagatccgacacgtaaggtgattatcaaaggaagacttcctcgaaagaaaaagacaaaatacctcaaccaatttgaacttcatcagttgatacaagaattacgtctcggagaggagctgaattgggattggctcatcttattgattgctaaaacaggtattcgattctccgaagcccttgctctcactactcaagattttgattttcaccgacagctattgaccattgataaaacatggaattataaaggagacggcggatttttacctacaaaaaataaatcttcaattcgaaaaatccaactcgactggcaaaccagcacccaattcgccaacttattacagcacacccaacctgatgacctacttttcgtgaagaaagagcggatttacaactctaccatcaatgccattcttgaaaagcgttgcctaagtgcaaatcttcctgtcgtcaccattcacgccctgcgacacacccatgcatctattttattatttgccggggtctctatcgcaagtgttgctagacgacttggtcatgcaagcataacaacgacccagaaaacctatcttcatatcattcgtgagttggaaaaccaagatgttgatttaattatgcggtcactctccggactttgttaaattccatgtttctacttatagcaaaagacgaatccgtatggaaccgtcttttcttatatatagtaaaaaactgttgcaatgaaattgttcaccaagtgtacgattattggatagattaagtatctactcttgtaatagaggagagacaaaataataccactgccagcatcaatcaaccaagagcctaagtctgttggaccatgaaaggagccaaaaacgaggcttgaaacaactattcctaacaaaacctgtgatccaaataatttcttaaagaagtagcctcgaaatatgacttcttctacaactgctggcaaaaatgctgttgtcaagagtgccagtctaaaaggaactcccttcaaaaattctataatcgaagcatcgttttctgttgtggtaacaccctgcaattccaacaaataataaccaagcatatccgtcaactgcatgatagcaaaggctaatataactatcgccagaccgtcccaagtaagaatgttagggtcccagactggcagatcattttttcagcccgccaccagaaaaagactaaaagtccaagtgtcatcagcccaactattaccaaggtgacttgcgatttggacccttccaaaatcagatccggaaggacagcaagcactaagagaccaaaaatccttaataatagccaaatcttccgaccaagccatttcaaactttgacctagtttctccatactcttctcctcttccgcttcatcatatagagtgccttcaatctattataggatttcacgtaatgtcaatcaaactgttctgttgttgtgatacagttttacaaaaattcaatgaatttgtcaatatacactaaaaaacaaatacccttacgatgtttgttgccatcaccccactgattatttagcgaggtgtgtcatcttcaagtagggctctagtagagaaaagccctgaatcaagcgttccagcagttcctcctcggaggcaacggttctaaacggtacatcatacttgaccaatactttacgaatccgtcctgcttcaacggcttgtaataggctctgtctattctcctccgttccgtccaggcgataaaatacctgtccctcttgcacccaataataaagcggtgccgcaatcgagcagttcagaacacgattttgctgaagcagagaggtctccactttctttcgttcaataaaactgacttctactgaaatccctgcttcagttcccttaccatacaaacgaatagcaagagccgagtccgttagactagcagagggaaaacggtaataggtccaaaaatgtggtctgcaaatttgggcttgattcatccattgactgaccctctcaggcacaaagggactgacgtgctcagctaagactaaacttaatgtctgaaactccttgcgtgctgcctgtgctacattttttaaggctatcatatcgcctgccaaagctcctgctttttcaggcttgcaataatgaactccttgataatccaggtatctgcgacactgttcaagcatctgaatctcctatccacttctccatatagaccatatccatgccttcttgttcaggctctgttttgatggccttgtagccgagcttttcgtagaaagaaactaatttagactcctgcaaaaccgtgcagagaacccagcgtctaactgtcggataaaggctttccaattcgagcatagccttgtgaccatagccttttcctctgtggtctggatcaataccaatcaagcctagccagccctgttcagcgtcttcagcgaccgttgtccgtactagtccgactgtgtgctcttcctcgataatcttgtaatagctacaatttggtcgtgcaaagcgtgattggaaatagtccatagtttcaatggcagggttgtactggtcctgataggttttatataaagccgcaaatgctcggtgctgaataggtagcaattcttctgcgtttgatagatctgcttttactaacatggaaaacctcctgaaattattttatccattgtatcaaatctatcaaaaaaatactaggtcttcctagtattttctaaagcgttgatagcggttttcgagtagttgttcaagtggtaaggcttgtagttgagccaactgactgaccaggttgtccttgatatcagacaagacttccttggtcgctctgccattttccaaaaccaccctatcgaccacttggagtttctccaactcataagaagtgatcttcatgagttctgccgcttccatggctcgactgccgtctttccagaggatagaggcgaaaccttcggggctgaggacggcgtacatggagttttccagcatccagacctggtctgccaccgctagagccagagctccaccagagccgccctctccgatgataatagcgataataggcaccttgaggtcactcatctccatgaggttgcgggcaatggcctcgccctgtccacgctcctcagcaccgacgcctgggtaggctccggcggtattgataaaagtgacaacagggcgaccaaacttttccgcctgcttcataaggcgaagggccttgcggtagccttctgggtggggctgaccgaaattccgtttgaggttgtcctgaaggttcttccctttttggataccgataactgtcaccggctgacctgctagaaagccgatgccacccactacagcttcgtcatcacggaaattgcgatcaccgtgcaattcgataaagtcatcaaagagttgtgtggcatagtccaaggtcgtcaggcgagcttggtcacgtgccaaacggatcatacgtgctacatcactggtcatctgacacctccatgcattctcagcaagcgactgatggtcgctggcaagtcctggcgtttgacaatagcatcgacaaagccgtgttcctgtaaaaattcagccttctggaaatcgtcaggcagattttcccgaacggttgactcaataacccgtcgtcctgcaaaaccaaccaaggtctgcggctcagctaggataatatcgccttccatggcaaaactagctgtcacacctcctgttgtggggtctgtcaagaccgtcaggtaaaagaggccagcattggaatggcgtttcacggctgcagaaatcttggccatttgcatcaggctcatgatgccttcctgcatccgagcaccgccagatgcggtaaagaggacgactggcaaacgctcttcaatcgccaactcaaagaggcgggtaattttctcaccgaccactgtgcccattgaagccatgataaagtgagaatccatgattccaagggcaactggctgaccgccgattgtcgccttgcctgtcaaaacagcttcatccaagcccgttttttgacgggtggctgctaatttctctaaataattggggaagtccagcggattagttgtttcaatccctgtaaacaattcctcaaacgatccttcatcaactgtcaaagcccggcgttcctgggctgtaatccgaaaattataggaacagtgttgacaggttttctctaatcctaaatcattcttgtaaaggatgaccttacaagcaggacatttagaaaagagttcatctggcacctctggctttgcttgaggtgctgactctatccgcgaacgattgggattgatgcggatatatttgtcctttttgcgaaacaaagccatagcattctcctagtttacttttttagatcttcttgatagcggggtaaaaattcttccatgaggtaggcagtgtcataatcaccagccaccactcgcttgtcggaaatcaagtccagctggaagtccgtattggtcaccactccgtcaatttccaattcgtagagggctcgctgcatcttcatcagggcttcaaaacgattttccccatgcacgatgaccttggcaatcatagaatcatagtaaggcggaatggtgtagcctggataaacagctgaatctacacgcaaaccaacgccaccacttggcaggtagagagtggaaatcttacctggacttggggcgaagttgaaggctggattttcagcattgatgcggcattcaatggcatgaccagtaatcttcacatcttcttggcggacactgagttcctgaccagccgcaatcttgatttgctccttgacaatgtccacaccggtgacaaattcggtaacaggatgttccacctgcacccgtgtgttcatttccatgaagtaaaattcgcccttggcttcgtccaaaagaaactcaatggttcctgcattttcatatccaactgactgggcagcccgcactgctgcttgaccgatacgttcccgcatggtctgaccgatagcaattgacggagcttcttctaaaactttttggttattgcgttgaagggaacaatcccgttctcccaaatgaatgacatgaccatgctgatccgccaaaatctgtacttcgatatggcgagctggatagacaacacgctctatatacatagctccgttatcaaaggctgctttggcttcgctggaagccgattcgaaggcaggcactaggtcttcagctttttccaccttacgaatccccttaccgccaccacctgccgatgccttgagcatgacagggtagccaatcttttcagcgatttcaagggcttcttgactggtcaaaacttcaccgtcagagcctggaataacaggcacttgagccttaaccatctccgcccgcgcgttgattttatcgcccatggtatccataaccgtcccagaaggtccgatgaacttgataccaacctcttcacagagggtggcgaatttggagttttcactcaaaaatccaaagccaggatgaatggcctgggcacctgtcacaacagccgccgagatgactgcctgcatattgagataggagtctgtcgaacgggctgggccgatacagacagcctcatctgccaacatggtgtggagagcttccttgtcagcctctgaatagacagccaccgtcgcaatccccaactctctggccgaacgaatgatccgcaccgcaatctcaccacgattagcaatcaaaatcttctcaaacatgatgaatcctatctcctttttaacatagaataattatttatcacaagctcagcccttaactagtttgcaaaataacggaccgattcatactcaatgaaaatcaaaatcaggctagctccaaaggtttgggaaagctttggaggttggagatagagcgaacgaagttcgtttctccaagagcagatatactcctgctactttcttatcttatggtagcaggctgtcaagctccactggagcttgacactcatcaaatcaagtcaacaacggctgagtttgattttcgaagagtattattttccaatagcaaaagtcaacgtccccgacgcagccagttttccttccacctctgcctttgcctcaacgaccgcaatggttccacggcgtttgacaaatttagcggtcatgattaactggtcaccaggtacaacttgcttcttaaatttaaccttgtccataccggcataaaagaccagcttgcccttgttttcttccttggataactccaagacacctgcggtttgtgccaaagcctccatgatgagaacacctggcatgacaggatagtctgggaaatgcccattgaagaagggctcattaatggtcacatttttgagggcaacaatctcatcttccgatacttcaaggacacgatcgaccaagagcataggatagagatgaggaagcgcctctttaattttcaaaatatcaatcatttgatgcgtaccaatccttgtccaaattctacaacatcttggttggccaccaaaatctctgtgaccacaccgtcacggtcagctggtacttcgttcatgaccttcatggcttcgataatcatgagggtctggccttttttaaccgtatccccaactgccacaaaggctggcttgtcaggggctggggacaaataagccacgccgaccaaggggctttccactaccgcaccttctgccacggggctggcacctgcttctgctggagctggctcactcatttcaactgctggcacaggggctgggcttgcaggagttactggggcaagcggagcttctaccgctggactcggagccactgtcgcctgctggtttttactgaaatgcaagatctccccagcattgctatacgaaaattctcgcaaacttgactggtcaaactgactcatcaggtccttaatttctgtaatattcacttaggcctcccaacgtttgaaagcgatgactgaattatgcccaccaaagccaaatgtatttgaaatggcatgacggatttccatatcacgcccctgtccataaatgacatccgcttcaatatcttcagataattctgtcgtaccagctgtctttggtgcataagaatgacgcatagcctcaatgacagctgccgcctcaactgcacccgccgcccccaacaagtgccctgtgaaggacttggtggaagaaactggcgtgttcttgccgaatacggatacaatagcttggctttcccctttttcattagccggtgtcgaagtgccatgggcattgatgtagtcaatatcagctggctctaaacctgcttctgaaatggccaacttcatggccttaatagcacccagaccttctggatgcggagaagtcatgtggtaagcatcgcaagtatttccataaccaacgatttccgccaaaatcgtcgctccacgcgcctctgcgtgttccaaactttccaatactaaaaccgcggaaccctctcccatgacaaaaccattgcggtccttgtcaaatggaatagacgcacgttctggatcctcagtagtcgacatagctgttaaagcttggaaaccaccgattgcaaacggagtaatggctgcctctgctccgccagccagcatcacatcttggaaaccaaacttgatttcacggaaggcttcccctaaagcatcatttgatgaagcgcaggctgtgatgatgcacttgcagacgccatttgcaccgacctgcatagcaatatttccagccgccatatttggcagggcctttggaagagccatgggacgaatgcgttttggacctttttcattcatacgagcaacttgctcttcaatttccaaaataccaccgatacctgttgataagataacaccaaaacggtcactatccactgtctctgtatccagctgtgcattagcaatcgcttctttagctgcatagagtgcatagagcgagtaattatcgtagcgatttgtatcctttttcacgaaatatttgtcaaaaggaaaatcttttaattccgcagcattatggaccgaatattcactggtatcaaacttggtaatctttccgatcccaattttcccagccttcaaactattccagaactcctctggcgtatttccgattggagatgtcagaccgtagcctgttactactacacgatttaattttgtcattttcagtcctttctcattaggaaacttactgcatggtcaagccgccgtcaaccgcaatcacctgtcctgttagatattcttgcttggcaagaaacactgcaacatcagctacttcttctgtcgcaccaaagcgtttcatcggaatttgtgcagtcatagcttctttaatcttgtcagataaaacatctgtcatatcagattggataaagcccggcgcaatcgcattgacacgaacatttcgcccagcaacctcacgggcaatggctttagtaaatccaatcacacctgccttagaagcagaatagttggcctgtccagcatttccaatcaagccagatacacttgatagattgataatagcaccctcacgagcctttgtcattggtttcaaaacagcctgcgtcatattaaaagttccagtaagatttaccttcagaaccgtatcaaaatcctcttctgtcatacgaagagccattccatctttggtaatccctgcattgttgaccaaaatatcgacgctaccgagtgtttcgatggcttctgccaccattcgtttggcatcttgcgcgcttgaaatatctcctgaaatagctaggactttcacaccgtaatctgcaaagctatccagcaagtcctgacctagctgaccacgaccattaagaacgacatttgctcctaaactggcaaatttatgagcaatagccaaaccgattcctcgacttgaacctgttacaaaaacatttttatttgttaattccatgattcctcctcatgatttgtttaatactatttgtagcccctctatatcttcaattgctacaacatgcgccgtcttatcgattttcttgacaaatcctgataagactttacctggaccgatttcaataaagttagtcacaccagcttcctgcatggttgcgattgactcatagaaacgaactggttccatcacttgacggggcaagagggacttgatgtcctcttttttcataacctcggcttccgtattaccgaccaactctacttggaagtccgcaagttccacctgctccaaggcctgagccaattgctccgacgctggtcgcaggagagccgtgtgaaaggggccagatacattgagcggaatcatccgcttgacacctgcttccttcagcaattcaaccgcctcatccactgcagccacctcgcctccgatgacgatttgggctggtgtgttgtagttggctggggaaacaatcccagaggtaacagtcgcacagatttcttcaatcaagttgacatctgtgttgagaacagcaaccatcttaccagtccctgctggcgcagccagttccatatattcaccacgcttagcaatcagggcaatcgcatcttcaaaggccaaagctcccgatgccaccagagctgaatattctcccaaggatagaccagctaccatgtcgggttgtattccctcttcttccagcagtcgaaaaatagccacagaagtggtcaaaatagcaggttgggtatagcgagtctgatgtaatttatcctcttgattgtcaattaggtcgcgaatgtcataccccagaatctgactagcctggtcaaacgtttctctaactatcgggtaatattcgtaaaggtcgcgagccatccccactgtctgagacccttgacctgcaaaaagaaaagctgtctttgtcatcctattctccaaccgaagcccaacggcttgcctcttctctaatcactttggctgctccataatagatatctttcaaaatatcttcacaagattcttctttagaaactagaccagcaatttgaccagccattacggagccatttgttacatcaccatcaacaactgcattgcgaagtgctcccgcaccaagctcttcaatagcatctgccgaaattttacctgccaagaaatctttctctgcagctgcataagcagatgacaacttattcttgatggctctcacaggatgtccaacaatagaagctgatacagttgtatcaatatccttagcttttaaaactttttccttataagcctgatgggcattggactctgtagctactacaaaacgagttccaacttgcaccgcttctgctcccaacataaaggctgccgctgcacctgcaccatctgcaatacctccagcagcaataacaggaatagatacagcttcaacaacctgacgaaccaaggtcatggtggtcaatttaccaatatgacctccggcttccataccttcagcaataacagcatctacccctaatttttccatgcgtttagcaagggctacactcggtacaacaggaataactgtaatccctgcagcatggagacgctccatatacttccctggatttcctgctcctgtggtgacaactttcacaccttcttcgatgaccaagtcaacaatgtcatccgcaaaaggagacaaaagcatgatattgacaccgaaaggtttgtccgtgatagatttaaccttgtcaatatttgccttgaccacctctttgggagcatttcctccaccgatgattcctagaccacctgcattagatacggcaccagccaaatctccatcagctacccaagccataccaccttgaaaaattggatacttaatatcgagcaattctgttattttcgtcttcataattccctcatctttttttcttgcttacctaatcatttgaatatcaaatcattaggtaaacaagtgaagggttgccccccctcactcaaaaaatagtttgatatttcaatgttttgattatcaaagtatttaacttaagaaaaatgctacatagcactctccttaacagtcattattttgttttttcttcaacataagcaaccaaatcgcctacagtagtcaaaccttcttcagtgtcgatttggatgtcgaatgcatcttcgatttcagagataacttggaaaagatccaatgaatctgcgtccaaatcctcaaaggttgttgtaagagttacttcttcagcatccttacccaattcttcaacgatgatttcctgtactttttcaaatactgccatgatatgtgtctccttttgtaaaataaaatattttaatcttgcctagggcaaggaattaactaaagttgtaagagtagagttccccatgtgaggcctccaccgaaaccagccatgagaatagtctggcttccatccaatcgcaacattccgctctctacacattctgataagagaataggaagacttgctgcactggtattgccatatttatccatatttgctggaaatttttcacgcgccactcccaatttacgagccatcttatccaggatacgtatattggcttggtggagcaagaaataatcaacgcaatccacagtcatatcagcttgttctagcagctctgccatggttgccgtaacatccctcgtagcaaattcaaatatagctctgccctccatttggataaagggttgctgacagctttgtgtcgagaatggcgtctctttctggtctatccctgctgtcagactagcacctcgaccgccatccgttcgcaagatttctgctaaaaaggtcggttgttcacacgcttccagcaaaactcctccagcaccatctccaaataaaacagccgttgatcgatccgaccagtcgacagacctagatagggtctctgcaccaatgacaagtcctctcttatagactcctgaagcaagcaatttttccgctgttgatagcgcaaaaacaaatcctgaacaagctgcaacgagatcataggcgaaagcgtttttcgcgccaattgctgcttgaaccatagctgctgtagatggcattgaagcatctggagtaatcgttgctacgatgatgaagtcaatttcactagcatctagctgagacttttccagtaattttctagccacttgactagccaaatcactcgtcgtctctccagtaacaatgtgccgttgaccgatacctgtacggctacgaatccactcatcactggtctccattcgttgagccaaatcatcattggtcacaatcttcttcggaagatagtgggccacctgactgattttagcatggtttctcatttcaaatcctccaagaagtgatagagtttcatgagtcctttcttcattacctgatactctgcatcatccataccatctgtaatctgtttcaccatttcattgtgaaatcgttgatgcaaacgatagaccagtcgaccttttttggtcagatagagatgaacaactcgccgatctttggtcgaacgaatacgctcaacatatccttttctttccaaattgttcaagctagttgtaacagtacctaaggttaccatcaaagtccgagcaacatcactcggagtagctccatcaatacttcctatcacatcaatcgtgtgcatttccttaatcgaaatatcattgaatcggctaccacgcagacttgtttcttcaatcaccaacacattgttaaaaatggccgttagatattcatttacttttggatcttccaaaacaggcctcctttactttgatagtcaaagtataaaccataaaactttgattgtcaaacattttttactaatttaaaaattaatctcccgtaaacactggtctacgtcgttctgcatgcgctcgaactccctctttaaaatcctctttataggctaatgtttcttgtaaatccagctccaatcggcgataagactcccagtctttaaattgactttcccatgtcaattgtttgattgctgcataagaatttactgagcctcgcaagagtttttttatgacctgggcaaccgtcttttctagtttttctggctctgccaatttataaataatcccatattctaaagccttatccgctgataagccctctccagtcatcgccaagtgactagcacgattagccccaatagcacgactcagtagaaagagcccccccgcatccggcgcaagtccaacgcctacaaaggcttggatgaattttgtcttgctggaggcaataacaaaatcagctgccactgccatattagccgcggctccagccactgccccatctgtcaccataatgactactttagacaatttcttcatcgcaaacgaaatatcattcaccagctctgctatttttaccaaagaagcaatatcatcatcatcaactgcacgcttcatctcaactaaatctccacccacggagaaaatggaaccctgtgcttgaatttgtaaaattttgacggaggcatccccttctgcaaggcggattgcttctaagatttcttcacacataggaatattaaaaccatttgccacttccggtctgtttaaagttagaatcgctacggaatcaattacttcataacgaattgtttgataggccattctcttgctcctttcaaaatagtttgataattaaaagatttgaatatcaaacttcaatttcttgttttccattgtaacatagtttttaaaattgtcacttttttctagcaaggaaagtgtgacgtccgaaaaagatggaggccatcatcgcaatataaaatttagatatgctagaaaataacgtgtctaagaatctatattcacacgcaaagcgccttggctttttcactcatcaaggtagttttgcgggaaatactgactgtattttgaaaaaacaacctcaatatgcaagtctgaactgtaaattataggctctaagtttaatttacaactttcattttttcacgttaatacttttggaagatttaactggattctgagctagaaataccatttttcacgagaactgatgcttggactacaatataatatttcttaaaatcgcaataagtcaaaggcatcttcaagattgtctaccaatttgtctgctttcgactgatcaattccataatgctggtctcgaatagcccaaactgtcaaacctgcttttttagccgcttcaatccccttcgcactatcttcaaatactaaaatgtccgatttagctactcctgttgcactagctgctttcatataaactgtgggatctggctttggggcctcacaatccatcgctgagaaaacatgactaaagtgaaagcgtataccagcatctagtagagcacgttcgatttctgaacggtcggtatttgaagccaaaactacaggaataccttggatagttagtctctccaataccgctttaacttcaggaaaaatcctctctgcataaggggttggtcgcttttctttatacacacgatattcttcttccaaggcagggacatcccagttatcataatcatcccctaaaatccgttgccaaatttgactagctcttccgccgacaaatatagatggatccaaatgatcaaccgataaaccttttgtcgctaaaaaatccgctcgacgttgaaaatagaatgtttctgtatcaaaaagtacaccatccatgtcgaaaataattgcttttaccatactcgcctcctattactttaattgtaacacagttgaaagaaaaaaatgtttttctgaaattttcatacttgtctcttgttcgtttttcgataaaattcttggcaagatttgtctgaacatactgacaatttcatatcattctgctataatagaaaaaaatatccaaggagatgagaatgaaagttattaaatttgggggaagctcacttgcttcagctggacagttagaaaaagttttcaatattgttcaatctgattcagaacgtcgctttgttgtggtgtctgcacctggaaaacgcaatgccgaggatactaaagttactgatgcgttgattaaatattataaagaatatgttaacggaaaagatgtgactgccagtcaagaatggatcatcaaccgttatcaagcaatggttgacgaacttggtttcacagctaacagcatgaagaaaatcgcagacagcatcatctctttggccagcctaccaattgatgataacgaattcctttacgacgcattcttagcagctggtgaagataataatgccaaattgattgccgaatattttacccacagaggattgcctgcacgctatgtccatcctaaaaaagctggtattattgtcagctccgaaccaggaaatgctcgcattttaccttcaagttatgacaaaatcgaagagcttcgtgatacagatgaagtactcattatcccaggatttttcggtgtaactgttgataaccagatttgtaccttctcacgaggtggatcggacattacaggttccatcattgctgccggggtcaaggctgacctctatgaaaactttacagatgtcgatggtatttttgcagcccatcctggcatcattaaaaatccacattcaatcaaagaattgacctatcgtgaaatgcgagaattagcttatgcaggtttctccgtcctccacgatgaagccctccttcctgcctatcgcggacgaattccattggttatcaaaaacaccaataacccaactcaccctggtacccgaattgtacacaaacataccgagcaaacagttcctgttgtcggtattgctgcagacgatggttttgtcagcattaacttgtccaaatacttgatgaaccgtgaagttggttttggtcgcaaggtattgcaaattctcgaagatctcaatattcgctgggagcacatgccgaccggtattgacgatttatccatcgtagtccgtgagcgtgaattgactcctatcaaggaagaagagatccttcgtcaactcaatacgaaaatggaagttgacaaggccgaaatcgaacatggtttatctattatcatgattgttggtgaaaatatgaagagccatgtcggtgtaacagctaccgctaccactgccctctctaaacaaaacgtcaacttggcaatgatttcacagggagccagtgaagtttctgttatgttcgttgtcaaaaccgaagaaaagaaacgcgccctgcacgcactctatgaagctttttttaacgagcaataatcacaacgaggtcgcttcatactcttcgaaaatcaaaaccagacgttgttgacttgatttgatgagtgtcaagctccattggagctagtctgattttaattttcattgagtaccaattaaaatttgaataaacaaaaatagcttagaatcaacgtttctgacgatgcaattctaagctattttttattttttatactcaatgaaaatcaaaagtagcctaggaaacgaagtcgaagatagaactggagttcatcaaggcaagttgacaacggataattttgattttcgaagagtattggactttttgaccagcctcattatagtcttttagtttacttttagtactcgctccaactatctgggagatagttggagactggggacaaagggagtgggaaagaactcgaccaagataaaaagagttcgtcttcccaccccccgcacagttgattaggccagatttggagtgcaaaacacgaacaaatatgccaatcaaccactgcgctgagatgttgacacgaactctgagtagtggtcctggactttttgcccagcctcatcaaaagccacaggcataactcaatgctttcttatttctaggtgaccagctgatgtacttcgcttttttgttttcaggctcaggtacgaatagtccactggactattcgtatcccccagattgcttgcacagtcaatggactgtgcaaggtgggagataatacttgcaaagcaagtcacttttacaaaatcaggcaaggcgagttcaaacaatccggtggagtgtttgaagttggaaatatggaaacgatatttcctcgattgtcaaagtaataaaaggcaactaaatgacgatatttgtattatagacaatctctaggcaacacttctctaatattttagccttctattttagtgaaagaagcggattatcatcacgtttactcaaaaattcgaggtagacgatctgtcaaaagacaaaccacctcgtaatttatggttccgatgcgatcagcccactcctgaacagagatcgttttatctccatcttgaccgattagggtgactttttgaccaagtggataagcacgaggtaaacgaatggtgatctggtccatcgaaatacgccctacaatttcacaggcctgcccatcgactaggactgataagccttgtaagcttcgtacgagaccatctgcatatcctatcggaacggtcgcaatccattctgaatcggtgctgtgataagtagctccatagccaattgttgtgccagcttcaacctgctttacatgaacaatttcagatacgagagataaggctggttgaacaccaaacgggagttctagtactcgtccacttggattaagtccataaagaatgtttcccaaacgaaccaggttaaatactgtatcagcatgccaaatgcttgttgctgaattgctggcatgaatccagcgcggagtaattggtagaacatccaaaaattctttaaaaacagacagttgactctcgaagtgcgcctgttcaacctcatccgcagtagcaaaatgagtatagactccttcgatgtcatactctaattcttcaaggatagcaatcgcttgtagcaaatcggctatttttctaaaaccaatccgccccatacctgtatccagcttaagatggacagttagaccagataaatcagcctctaagtcttttgcatcttgcaaccagtccagactggcaactgtcacactgatattgagttgatgagctactggtaaaaaacgtacaggaaccactcctaaaatcaagataggatgctcgatacccgctttacgtaactctaatgcttcatccaaattcgaaacacaaaaaccagctgcttgactggataactttttcgctaccgcaacagctccatgaccataagcattcgccttaacaacagcaaatgcttcagtcttagggggcaagttggtcattacttgctcgaaattttccgcaatcgcatctaagttaacccgaatttgcgtgggtcgatgttcactttcaatcatctttctcctccaaaatcacactagcttgtacaaaatttcctgaatggctaatgctgagccaaatattcccatcaaagggactcttcgtcacatagggaactcctttgctggtattcagaatttcaatatcatgaaatcctatcttaccaatgcctgtccccaaggccttggtcagtgcttctttggctgaccaacgtccagctaaatattctagctgacggcgaccggacagactttgataccgttcaaattctttctctgtgagaatctttttgggaaacccttggtgtttgattctggcactttcaatcgcctccatctcctgaaggtcaatgccatgtcctactatcattaatcggtctccttttgcatagtcacttcatttattaaaataaacgaactgactctagtgacttgtctaaaaattgcaaaaggactggacagccgtccagtccacgcgtcattcctatttacggccgtgacaatttttaaatttcttaccagactggcatgggcatggatcgttacgatcaacaccttcaaaagatacattctcctgaattgcatgcgattggttcggcataatattcttaacagctgtcgtatgtgcttcttgacttgtacgctcacgctcaatattgtcatgaatttgcgccttcatcatcaagcgggttacttcaaactcgatagccccaatcatatcgttgaacatagtaaatgcttctgattgatattcaacgattggattgttttgagcgtatccacgaagactgactgcattgcgcaattgatccaaggcatcaatatggtctgtccatttgttatccacaacacgaaggataagaactttctggaattcgcgtacacgttcttcatcgcgtaattttttcacttgcgaatcatagactctcaaagcacgttcatagagctcttcgacaatctctttctgattcattgcttcaaaagtagctttactcaaggtatcatcttcaacgagatttgcatgcgcaaatttgataataccatcaatagcttcatctttcgaaccaaggaagtgacccgcaacttggcgttcaatcgtccgtttcatcatcgctttgatttcaggagccaaatcacggtcagcagtaataacatcctggcgttggcgatagatgatttcacgttgctcacgcatcacatcgtcatattgaaggacttgtttacgtgagtcgtagttgttcccttccacacgcttctgagcagattcaacttgacgtgtcaacattttagacttgataacggactcttcttctgttagattcatacgctccataaatactttgatgcgttctgaaccaaagcgtttcatcaagtcatcttcgagagatagatagaattgtgattcacctgggtccccttgacgacctgaacgtccacgaagctggttatcaatacgacgactttcatggcgctcagtaccaataacacacaacccaccaagttcacgtacacctggacctaacttaatatcggtaccgcgtcccgccatgttggtcgcaatagtgaccgcaccacgctgaccagcattcataataatctgtgcttcacgatagtggtttttagcattcaatacttcgtgagggacacctgcagctaccaatttttgagaaatcaaatcagaagtttcaaccgcaactgtaccgaccaagacaggttgccctttctcatagcgtctcttcacatcagcaataacggcattaaatttgtattctagacttggatagagtaaatcttcgtggtcaacacgcgcgattggacggttggttggaattggtacaacacggatgttgtagatttcacggaattcttcctcttctgttttaccagtacccgtcatccccgataactttttatacatacggaaaaggttttggtaggtaatagaggcacttgtcttagactcgttttgaaccggtacaccttccttagcttcgatggcttggtgaagtccatcagaataacgacgaccttccatcgtacgacctgtaaatggatcgataatcatgacctcttggtcttcattgaccagatagtcaatatcataggtcatgatgtagttggcacgaagtgcattatccaagaaatgggtaatggctacattttcaatatcgtagaggttatctaacttgaagaatttctctgctttgtcaatacctgaatcagacagtccaatcgttttagatggaatgtcaatgatgtaatcttctgttgtcaaagatttaacaagattatctgccaagaaatacaactggtttgtttccgaaccttgtgcaccagatacaatcaacggcgtacgagcttcatcaatcaagattgagtcaacttcatcgaccaaggcataattgagaggacgttgaaccatgtcttctgcgcgaacaaccatattgtctcggagatagtcaaaaccaatctctgagttggtcgaataagtaatatcgcagttataggcctcacgtttttccaagggtgatttagcagctaagttgataccaactgatagaccaagccatgaatacaattcacccatttcagtcgcatcacgggtagaaagatactcgttaaccgtcactacgtgaacaccttgaccagacaaggcattcaaataaacaggcatcgttgcagtcagagttttaccttcacctgtacgcatttctggaacgtcaccgttgtgaagaacgattcctcccataacctgaaccttgtagggatagagacccaagacacgtcgagctccttcacggactaccgcataagcttcgtacaaaagatcgtcgagggattcaccgttattgtagcgctccttaaattctgctgtcttagcttgcaactgttcatcagtcagcgcttccatttcatcggcatacgagaagaccttgtctgccattttctcaagttttcttagctctcccttatcattttcaatgagagaacgaagtacatttgttaccatacatttcatcctatttcagttttagtcaataatatattgtagcagaaaactaggcaattttcaaggtttggcactaggatacagcctaaataaatgaaaatgctagcttaatattactatttttaccacaaaacacctcctagtcacaataactcctaggaggtgaaaaatttataaaattttaaatgaggaatctgcgatatatcggagatttagaaattcattaaaagctcagttatcatattattcagttaataaaagctcacatgaataattttctacacaaagataaacgtcatctttaacctgtgttaatatattattttcctcgagaaaaatatctcatgaagaaactagtagataaagctacccaaattgttactaagctgttaagtacattttccgaagtaaggatctcttttttctctggctctcgattctcaattgttgcatttgaatcgaccactttttcttcctcaacagaattgttactacgttcaagagaggtaggcactttcaccttgccagctactgcacttctctcttgagaagaagttgcaacacctacaggctcaactgttgaaattgcttcttcaaacaatgtcgcagataaagagtaaggttgaggcaccgtgtctgaaccagcatcttgaacacgaatatctgatgtcggaacagaaactgcctcatgagtatttgcttcaactccatttggcgtagttgcatctgctttctcgtctaaatgttcatttttaggaacctctaaagtaagtgaagcagaacttgtttgtggagcagaaaccagtgggtcagctacttcttgtttagctaccaccacctctgtagaattagcttccggtgaagttggggatgctgaactactcgcaactacacttggttctgttacttctgttgccacttctgctggagctgtttctgatgaagttgggatttcagaaattacttgtggagctgaaaccggtgagtcagctacttcttgtttagctaccaccacctctgtagaagctgtttccggtgaagttgggatttcagaacttacttgtggagcagaaaccggtgcttcagctacttcttgactagttgttaccgtctctgtaggagttgtttccggtgaaggttgagatgctgaactactctcttccgatacttctgttgccacttctgctggagctgtttctgatgaagttgggatttcagaacttacttgtggaacagaaaccgaaggttcagccatttcttgactagttgttactgcctctgcagaattagtttccggtgaagttggggatgctgaattactctcaactacacttggttccggtgtttctgttacctcctctgtaggagttgtttccaatgaagtttgaggtgctggattactctcaagtgcacttaattccggtgcttctgttgccacctctgtaggagctgtttctgataaagtttggatttcagaacttacttgtggagcagaaaccggtgctttagctacttcttgactagttgttaccacctcggcagaattagtttccggtgaagtttgagatgctgaaattacttgtggggcagaaacccgtgattcagctttttcttgactagctgttaccgtatctgtagaaatagtttctgatgaagttggggatgcagaacttacttgtggagaggaaactgtattaacctgcgcttcactcgattctttggatgaaggctcaacatatggtaatttagcatcactttcttccttagaatcaactgtattctgagctgtttctgaactcggtgaaaccatctctgtatttcctaaagatgaagtctctgttttatcctctaactcagttttagcttgtagtgccttaggagctgctggtgtttgttgagaaggagcagctgagattgtttcctgtgttgaaggagttccttcaagctcctcagattgctgtgcagaattaacacttggagccgaagcatccttggaattttggctgacttcatcagaattagcttggttttcttgcaattcatttcggtttctatcatcatcagaatttgtgttatttttctgacgattctttagataactttgataagtttctccttccgaaaattcttttccagccttcgcattcatttgccccaagaacactcgagctaaatccattgaattttcgagtgctttaaattcttcttctgtaatcttggagagagcactcaatttatcaatatcagaattgacaaattgtaaaacacgatcatacccctcttgtttatcatctttatcgtctttatccgttgctttcgtttcttctactttacgtttcaaagctttatagatgtctagcaaatgatttttcttattttctgttatataagttggctcaacatatgcaatataatccaaaccaaccaaggacttttctttgttgaacaacagtaaatctgctgttttttgtttcatagcccaactctcataattactatcaataatcatgtagttacgctccgccttaggctcctgtcctgcctcaacaacatcataactatcctcaccaatagtagaaaagtgtttctcgctatatttagctgagcgctgatgcttattccctgtaataaaacctgtaccgtcaatggtgtgccactttttatcataataaacacgcgctgtagcatgcgggacaccttctgcatttttcccaacaacaacataagcaggaagccctaacatattaaatgcacgggccgcagtagtgctgaaacctacacacatcgctttctgacgttcagtaaccgcgaacaaatctgatcctaagtagtaattgatgtctgcataattttgaacagccttattagcagcttcccaatcatatgttgtatgattggcaacatactgaacaaatgccttaactttatcgcgttcacttgattgcttcatagcttctgaggactctatcaacttatgaatcaagtcatcatttgctataaaacgctctttggtaacgtttatatttttaactgaattatgagtatatttactataatcctcatagtacttattatcaactgtaagaccatgcgagtaaatagtcattccattaatatttttcaaactattctcagcagttcctagacccgcagcatttaataactgccgtttattggagtcaagctcaatcttaaatagtgcatgaatccgttttggctccatactattatgtaagtcgccatttcccgaaaacctcaactctctcatctgattatgataatcttcctcattatgagcaataacatcacccttgttcataacaaggatatgtggaaagtcatgaatattttgagtaactttaccattgattaccaaaaaattgttgtttttaccaaattcttccaattcttcccgagttgataatgttcccagtcgattttcaaatcctaatttcaaaacatgaaattgtcgttggtccgaggagtagtctttcaattttttagaaaatgcttcccagttcagaacctctattttattggtgttttttggcgattgtaaatgtgagttttcatctgcaaaaacaaccggttgtgatgttccgatagatgcaagcgcaagaaccgaagtagaaagggtaagtgtcaaaataagccagcgcttaccatgctgttgaattggaatcataagtcctccatataagtacttctgagaataatttcccagcctaaaatttgcatcccaattgtaacacttttaactatcttttttctgctatctatctgtgcttttcctgtttttatagactttagtgtctccgcatcatcactttagatatagcgttttcatacaattgggaaacaacaactttcctctggttaaaaaatatcactacactatcgccaataaaaagattttcaaccttgcttatgaataatcatcaaaagttgtggaactcgtttctctttttcatacccgatgaactccaacaatggcaaactctaatcttttatagtcatcgttagtttttgaggcgctgtttcggctcaaaaacttaaattgaagagttgttgacgaactcttttaagctggtcgagttctttcctactccccaaaactgccttgattaacgaatggctatctcttatgaatacagttttttagataaaaagaagtgagagttacataaaaactctcacttcactgtcaagttattgtgataataaaacaacttcacccaatattcttcaatatatctatcgccaaagtacaaatgaatctgttctcatagacaattatgaatttcttgacacctgttttgccaaagcaaagttcccaagagttgcagaaccattttcagcaacagctggcgttacgatatattctttgacatctggtgttgggagataatcgttcatcaaaccgacaaacttctcacgtacacgattaagcatgtgctcttgagccataactcctccaccaaatacaattacttgcggacgataaagcaaggttgcctgtactgctgcttgagcaatgtagtaagcctgcacatcccaaacgtctgaattgagctcgatcaattcaccacgaatacctgtacgaccttcaagagaaggacctgcaactaagccttccaaacacccattgtggaatggacacattcctttaaattcatgttttacatcgtaagggtgtagggcaacgtaagtatgacccgcttcggtatgacccaagccaccgataaactcaccattctgaatagcacctgcaccaatacctgtaccgattgtatagtaaaccaagctctttacccctttacgaaccagggtttcaccaaaagctgatgaattcacatctgtcgtgaagtagaatggaatgttaaattccttagcaatcagaccaagtaaatcaatatttgaccagtgtggttttggtgtcgaagtgatgtaaccataagtctgtgagttttgatcaatatcaattggaccgaaagaacctatcgcaatacctgccaaacgatcttcatagcgcttgaagaattcaactgttctctcaatcgtttcataaggagttgtcgttggaaattgcgttttttcaacaacttgaaagttctcatcacctactgcacaaacaaactttgtaccaccagcttctaagctaccatataattttgtcatttgattgtctccaaaatttttatcacttttattataacatataagcaaacagaagaaaaaggctgaaagcctttttcctgttaattatgtagtagagtcatgctctacaaatcgattttatataagattacttagctactttcaagaattctacaccgtgagcgattgttccctctgcaagtggagatacttctgcaaagtcagcagtgttggtcacgatgatcatggttgtatcatcaagacctgcttcagcaatcttagctgcatcaaatttagcaagcggagtaccagcttttactttatcacctgctgctactaatttttcaaatccattaccattcattgatacagtatcaataccgatgtgaattaaaagttcagcaccagacgctgttttcaatccgtaagcatggcctgtttcaaaagcaattgttacttctgcatctgctggagcgtaaacaacaccctcagatggtttaacagccaaacctttacccatagctcctgatgagaagactgggtcattaacattttcaagggcaacaacatcacctgaaagtggagatacaagagtttcttcgttgagctcaacagctggagttgcaggtgttgctactggagctgccgctgctttaggtgcagcttctacttcatcttcaaaaccgaagaggtaagtcaatgcaaaaccaagagcaaatgatacagctaccataaggatgtattggaacaattgaccattaccaacataaagtgtcgcaccaggaatgatggttacacccatacctttaccagcaagaccaagaagagatgctacagcaccaccgatggcaccagcaatcaatgaaagaagaaatggtttgcggaaacgcaagttcacaccgaagatagctggctcagtaataccgaggaaggcagaaagagctgctgggaaagcaagagctttcaatttaggatttttagttttcacaccaaccgctactgtagcagcaccttgtgctgtcatagctgcagtgatgatagcgttgaatgggttagcaccagtgtttgctaccaattgagcttccaagaagttgaagatatggtgaacacctgatacaacgataacttggtgaacaccaccgataaggagaccaccaagccccattggcaagttcaagatagcttgtgtaccagctaagatgtagttttcaaccacgtggaagactggaccgatgacaaacaaaccaagaatagacatgacaaacaaagtcacgaatggtgttactaagaggtcaagaacttctggaacaaccttgcggactgctttttcaaatttagcaccaaccaaaccgatgatgaaggctggcaatactgaaccttgcaaaccaacaactgggatgaaaccgaagaaaatggttggcttcacatcaccacctgaagcaacgacccaagcatttggcaattgaccagcaatcagcatcataccaagtacgataccgatagtttggttcccaccgaatacgcggaaggttgaccataccaccaaggctggcaagacgatgaaggctgtatcagtcaagatttgtgagtaaacgttcaaatcttctggaagagtatagccgagagctccaagaagaccacgaagacccatgaaaagaccagttgctacgatagcaggaatgattggaacgaatacatcaccgaaagtacggatagcacgttggaatgcattgccttgtttagcagcttcagctttttgttcaccagtagtcgctgttggcaaaccaagggcaaccacttcatcgtagattttgtttactgtaccagtaccaaagatgatttggtattgaccagagttgaagaaagcaccttgtactttttcgatgtcttcgactgtatccttgtcgatttttccttcatcaacaaccattacacggaggcgagtcgcacagtgagcaacactgcgtacgttctcacgtccaccaagggcgtcaatgactttttttgcaatttctgtattattcatcttgcaaaaatctccttattaaatattttttgttttttgaaagtgttttcaaactttcgatggttttattatatcacttttataaaatatgtcaaacgtttatcacattttgtttcaattttatcaaaaaacattgttaaaacttgatttttcgcaagaaaacgtttactatattaatgaaaaactagaaaatttggagaaaattatggcatttacaacaggggagcgttacagagcttatgctgactggacacccgaatacattgaaaaaataaagaagaatacagagagttctccttggaggacaaatttccatattgaaacaccacatggactgttaaatgatccaaatggattttcttattttaatggaaagtggactcttttttaccaatacttcccattcggtgctgcgcacggattgaaatcgtgggtccatacagaatcaacagatttggtccattttgaagaaactggtacggttatgtacccagatacaccacttgatagccatggtgcctactctggatctgccatggaatttggcgacaagctcttcctcttctacactggaaatgtccgcgatgaaaattgggttcgccatccataccaaatcggtgccttgatggataaagatggtaagattgaaaagattgataaagtcttgattgagcaaccagaagataccaccgaccatttccgtgatccacaaattttcaactataaagggcaatattacgctattgtcggtggacaaaatctggataaaaagggaattgtcaaactttataaagctgaaaataacgactacctcaactggtcctatgttggtgaccttgattttgccaatgatatgaccgcttatatgatggaatgcccaaatattgcgttcgtcggtgagcaacccatccttctctattgtccacaaggtttggacaaagaggtattggactatggcaatatctatccaaatatgtacaagattggtcagagtttcgttcctgaaacagcaagcattgtcgaaccgagcgaattgatcaatctggactatggttttgagtgctatgcaacccaggcctttaatgcaccagacggtcgaactctatctgttagctggttggcacttccagatgtggaatacccaaccgatgcttatgactaccaaggctgtctgtcattggttaaagaattaaccatcaaggacggtaagctctaccaatatccagtcgatgcgattaccagtcttcgtaaagaagctcagccattttcagcccaaaaagaaaccaataatgtttacgaattggaacttgatttttcagcgagcacgaagcacgaaatcgtattgttcgcaaatgaagcagaaaaaggcttggtcttgtctgtagacactgaacaaggccagattacattggaccgtggcaactgtggtcagccattcgcactcgatttcggcacaagtcgctcttgcgagatttctccaggagctcttacagccaatatcttcatcgacaaatctgtctttgaaatctttatcaataaaggagagaaagtattttctggtcgtgtcttccctgatgcggatcagtctggtatagtcattacgactggtaatccgaccggaacctactaccatttagattatggtcgcaaaactaactgatgtcgcacagttagctggggtcagcccaacaactgtctcgcgcgttatcaataaaaaaggatacctatctgaaaaaaccattcgcaatgtcgaagaggctatgcgtgaactaggctacaaacctaataatttagctcgtagtttgcaaggtaaatctgcaaaattagttggtctcatcttcccaacaataaacaatattttttattctgaattgattagccatttagaaaaagagctttttgatcgaggctataaaaccattatttgcaatagccagcacgagtccgataaggaacgtgagtatctagaaatgttagcagctaaccaagtagatgggattatctcgggcagtcacaatctcggtatccaagactacgaccgtgtcgtagctccaattatcgcttttgaccgcaacctatctccttccattcccattgtctcttccgataattttgctggcggggtattagctgcccaaaccttacaaaaagcgggatgtcacaatccattaatgattacggggaacgatgattccaattcacctaccggccttcgccaagtaggttttacatctattttgaacaaagccgaagtttttcatatctccagtgatttctcacctgtgcgtaaggagatggaaatccgagccattcttgaaaagcaaaaaccaaatggtatctttgtatctggcgatgcaacggctatgctggtatggaacgtcattcgttcaatgaaactgtctattccagaagatattaaattgattggttatgatggaaccagtttcatcgaaaactactaccctcaactgacaactatcaagcaaccattaaccgaaatagctcgcctgctggttgaactattagttgataaaatcgaaggaaaaaaactgacaaaaacagactatatcctgccgattagcctactagcaggagctagtatataaaaaaagctgtacctaataaaaattaggtgcagcttttttgtgatacattctcttatttctcaagtaaaaaagaagctcatcaggcttcttctttaataaactggctcaaaactccattgacaaacttagctgaagattcatcagaaaattctttagccaattcaatagcctcgttaacagcaacgcggtctggcgtttcttcgaaatgtaagatttcaaataggcctagtcgcatgatattcttgtcaatcaaggttaaacggtctaaggtccatcctgcttttaatcggctagataactccttatccaagtcatcacgatagtctgctacaccattgacaaggttaaggagaaagagcggaatttcaactccttcttgctcttcttctctatcataaagataagaaaactgagctgcctgaacaggttcttgaccaaattcaagtgatacgattgcctgcaaagcacacttacgcagggcatgtctattattcttcatcaaggaaatcctctccgaataaatctttcaatgctggttttggtgttttatcaggaacaatgccgctgacatggatattaaccgcagccacttgaacttctgcatagttataaactgctgtcttgactgcacgttggatgtccattgatacggcaggaacatttacaccatattctagatagacgtaaatatccgcagtcactcgaccttcctcgtcagtttcaagataaacacctttatttaacgatgtttttgaccaactgtctgctacacgcttattttgaagggaatgcactccatcaactttcgctgcagcaatgcctgtaattacttcaaggacgcgaggtgcgataacaatctcgccttgatattctgttgtcataggctctcctttcttaagaggaaacgattaagcacgtgatacgtaagttccttcagctgtgttgataacgagtttttgacctgcttcgataaagtctggtacgttgactacaagacctgtttccatcgtagctggtttacctgaacctgtaacagtcgcacctttgatagatggttgtgtttctgcaacgaccaattcaacagttgttggtacagtaacaccgatcacttctgttccgtagaactggatcttcacttcagaattctccaagatgtagagcaattcttctttgatagtcgctactggaatttcatactgatcgtaagtctcagtattcataaaataagctgtgtcatccatttggtaaaggtactgtgctggaactgtttcgataatagcttgttcaaatttttcatctggacggtaagttgtatcgaaggttgaacctgtacgtacatcacgcaatttcatacgcatgatggtgttacctttacctggtttgtggtggctcgcatccaaaactttaatcaatttaccttcagcttcgaaggtcatacctgctctaagtttacttgcttcaatcattgtattgaatacctcttcaaattttatttattcgttttattctaccacaaactgtcaaatttctcaaatgacaatcaattccttgggagctaatgtcaagacttcacaaccgttttccgtaatcaataggtcatcttcgatacggacaccatatttgtcatccaaatagataccaggctcatccgtcaaaaccataccggccttgatagtctcgtcagattttccaaaatacggatattcatgaatatccaagccaataccgtgaccgatgccgtgtgtaaagttggctccgtaacccgccgcactgataatctcacgaggaatagcgtcaaactcgcggtaggtgacaccttccttggcctgctcaatcaaagccttattggcacgcaagaccacatcgtaaatctcacgctcttgatctgtcacatgaccgatatggatggtccgtgtcatatcgctgacataatgctggtaatagcaaccaaaatccagcgtcaaggtctcaccagattggataaccttttcagacgctcttccatgaggcatagcagagcggtagccagatgccacgatgaactcaaatgatgccccttctgcaccgagttgacgcatgcggtggtcaaggaaatgattgacgtccatctcagtcgtctgacctggtttgataaagtcaagaacatcaataaaagcctgatccgaaatttgacatgcacggcgaatggtcgcaatttctttctcatccttaatcatgcgcaagtcttcgataaagtttgacatagcaaccagttgataaccctcaaaaatgctggtcagactttgatagaaaccataggtcacctcgctatcaaaaccaattttttcaagcccatcttccttaatcacctttgcaatttcttcaagggcaaaacggctctcgataatatcaaaaccttttactgatgccttggctatcaaggtataacgcgaatcagtcacaaacaagcgacgcttgccactaatgaagacagtcgcctctgtcccccaaaaacctgtcaggtagtaaatattgttttgaccagttaccaagattccatcaacagttgattgagctaattttgcttcaaatttttcaagtcttttttgcatcctattcctccaatgattttttaactattatagcagaaatacagacaaataccaattcttcctagcagatagagaaaaaaagccgcagaggcgactttttatttcaacttcattttcagatactggcctgtaaagctggctgggttctccgccacttcttctggtgttcctgtcgcgacaacggtaccgccaccgacaccgccttccggtcccatgtcgataatgtggtcggctgtcttgataacatccagattgtgctcgatgaccagcacggtattgccatcatcaacaaagcgagccaagaccttgagcaactgggcaatgtcctccgtatgcagacctgtcgtcggctcatccaagatatacaaggatttaccagttgaccgcttgtggagttcagaagccaacttcatacgctgggcttccccacctgatagggtcgttgctggctgacctagagtaacgtagcccaaacctacatcttgaatagtacgaagtttccgctcaatttttggaatatgcttgaagaactcgaccgcgtcattgaccgtcatatcaaggacctgagcgatatttttctccttgtagtgtacttccaaggtttcagaattatagcggtgtccatgacagacttcacaaggtacaaagacatcgggcaggaagtgcatttcaatcttgataatcccatcaccagaacaagcctcacaccgtccacctttgacgttaaaggagaaacggcccttcttgtagccacgaatcttggcttcattggtctgggcaaacaaatcccgaatatcgtcaaagacacctgtgtaggtagctgggttagaacgtggtgtccgtccaatcgggctttggtcaatatcaatcaggcggtccaagtgttcaattcctgaaatagacttgaacttacctggcttgtccgaattgcgattgagtttctgagcaatagcttttttcagaatggaattgaccagagttgacttacctgagccagacacccctgtcaccgctacaaattttccgagtgggaaacgaacagtcacatcttgcaggttgttttccttggcaccggtcacctctaagaatcgaccatttccaacacgacgttccaaaggaactggaatttcacgtttgccagacaggtactggcctgtaatggatttcttgtttttagctacttgggctggtgtgccagaggccacgatttctccgccaaacacacccgcacctggaccgatgtcaatcaaccagtccgcctcacgcatagtgtcctcatcatgctccaccacaatcaatgtattgcccaaatcacgcattttcttaagactagcaatcagacggtcattgtcccgctggtgcagaccaatcgacggctcatccagaatatagaggacaccagacaggttagagccaatctgagtcgccagacgaatccgctggctctcaccaccagaaagggtacctgctgctcgtgaaagagtcagatagttgagaccaacgttatttaggaaggacaggcgatccttgatttccttgacaatgggtgttgcaatggtggcttcattttcagacaaggtcagatgttcaatgacttgcaaatgatccgccacggacaagtctgataattgtccgatatgaagtccctgctcgcctccgactttgacagacagggcttggtcattgaggcgatagccgtggcaggtcccacaggtcagttcattcatgtaagtcttcatgactgtccgtgtgtaatcactattggtttcacgatagcggcgattaatgttggtaatcaagccctcgaatggaatgtcaatatctcggactccaccgaactcattttcataatggaaatggaattctttcccgtcagaaccgttgaaaatcaggttcttctcctcttccgtcaattcctcaaaaggcttgtccatgtccacaccaaagtgattcatggcctgctccaacatctgaggatagtagttggatgagattggattccaaggagccaaggcaccttcacgcaaggtcttgctggcatctgggacaatcaaatccgtatccacttccagcttcatgcccaaaccgtcacagtcgctacaagacccaaaaggagcattgaaagagaagaggcgaggctccaactctggtaccgtaaaaccacaaactgggcaggcatagtactcagagaaaagcatttccttctcatccatggtgtcgatgatgacatagccgtccgcaatccgcagggccgcctcaatggagtcaaaaagccgcgagcgaatgccatctttgatcacaatccgatcgaccacaacttcaatattatgagccttgctcttggacaattctggtacttccgacacatcatagacaccgccattgacacgtacccgaacatagccgtccttctggattttctcaaaaatggtcttgtgttgcccctttttcttacgaacaatcggagctagaatctgcaaacgttggcgttctggcaattccaagacctcatcaacgatttgttccaccgaagaagccgcaatcgctccgtggccattgatacagtaaggtaccccaacccgagcataaagcaagcggagatagtcattgatttccgtcgctgtaccgactgtcgaacgcggattccgcgatgtggttttttggtcaatggaaatagcagggctgagaccctctatggaatccacatcaggcttgtccatgttgcccaagaactgacgagcataggcagacaaagactccacatagcgacgttgaccctcggcatacaaggtatcgaaagccaaactcgacttaccagaccccgacaaaccagtcaccaccaccagcttctcacgcggaatggtcacatcaatatttttcaaattatgggcacgcgccccatgaatcacaatattttcttgcataacatgatataagtgcgttaagaaagcgataagaaaataggaaaatgtgacgtcacatcagtgacaaaacattttgtctttttctcgacgcttttagcacgcattcgaatcctttctaagatataaagagcatcaaatgcacagtcaaaataggcggtaagtccgaattctgtgatttcgaagatgcacccccttcaagacaactagtgctttcacaggttgaaaaccgaagaaagtacagatgtctacgacgcagaaaccagttcccatacttatccatgaagaaactagcactttttgacaccgcatttagcccgtgttcaattcctttcttaagaggctataagctatggtatacggaacaaggaaaagtccgtacaacttattcgcttaaatgtctacatattatatcacatttctatataaaacctttccgaaactgcacattttttggtataatagaggttgcgttaacgcaacaaagataaaaggagggcaaagatatgaaacaaatttttctatcaaccatgactgatttagaagaaatccaaacctttgaaccaggggcttggattaatttggtcaacccctcccagagcgagtctatggaagtggctgagcactataaaattgacatcgctgacctgcgagcaccgctcgatgcggaagaatcctctcgtatcaccgtcgaagatgactatacgctcatcctggtcgacgtcccaattcttgaagaacggaacaacaagacatattatattactattcctttgggaattattctaacagatgatgcaattatcacgacttgtttggaaccattgccactgtttgagcagtttatccatcgtcgtctacggaatttcttcactttcatgaagtctcgtttcgttttccaaattctctaccgaaatgctcaactctacttgtcagccctacggaccattgacagaaagagcgaagagattgagaagcaactccatgaagccactcgaaatgaagaattaattgtactcatggaattagaaaaaaccatcgtctacttcaaggcttccctcaaaaccaatgagcgtttggtcaaaaaacttgctagttcctcacgcctactccgtaagtatgaagaggatgaggatttgcttgaagataccttggtcgaaacccaacaggccattgagatggcagacatctatggttccatcctgaactctatgacccatgcctttgcttctatcatttctaacaaccagaataccatcatgaaaaccttggcattagtgacaatcgttctctctatcccaaccatggtcttctctgcatacggtatgaactttaaggacaacatcattccttttaacgatattccctatgctttttggtggattatcctcttcgcatttgcaatcagcctatcactcaccttctacttcatccgtaagagatggttttaaactaaggagattaacatgtcatttacagaaatcaacggattaacaaaaaagaaccaagaatttatccatattgcgaccaaccaactgattaaagatggaaagtctgatagcgaaatcaaagaactcttggaagaaattttaccaactatcattgaaaagcaaaaaactggtgtgactgcccgcaatctctatggagcaccaagtgagtgggctgctagtaagacaatttctgaacaggaaaagaaagaccaagtggaatacaatgaaaatccatggttgatgtggctagattctagtcttttcatgcttgcaattattgctggtatcaatggtttgatgaatctttttggtcaaggtgcacagtatgggctattaaccttatttgtcatcggtttcggtgttggtgcagggatgtacttgatgtaccatttcgtttacagagaacaaattaaaactgggcaacgtcctaaattgctgaaagctatcgcttttctcggacttgctacgctggcttggtcagtcgttttcattctggcagcactgattccggccgcatttaacccggttcttcctccgcttgttactattcttatcggagctgctgctttcggtgcacgctacctcttgaaaaagaaatataacattcgcaatgccatgtccccagttcaataataaaacaaagcgattggaatattccagtcgcttttgtttatctatacagttcagctatcaaatcgcccgagaaccttatccgctgtcacttgtctatgtaatctgctgaaacagtctatccccagactgtgcctcgctttctaacttcttggctcgggttgaaacagtccattcaaaggcttaattcgctttcttaatttcgagttcatgaaaaaatggtccactctcgccgttgcgcctttccagtttcttgggcgcaagctaaaaagacccgtcggggtctcaattcgctttcttattttcatgctcatgaaaaaacagtccattctcgccgttgcgcctttccagtttcttgggcgcaagaaaaaatggtccactggaccatttttttaatcttcgtttacgaatggtaaaagagccataacgcgagcacgtttgatagctgttgttactttacgttggtttttagctgaagttccagttacacggcgtggaaggatttttccacgttcagaaatgaaacggctaagaagctcagtatctttgtaatcaacatattcaattttgttagctgcgatatagtcaacttttttacggcgtttgaaaccgccacgacgttgttgagccatgtgtgttctcctttatattattaatttttgacctagaatggtaggtcatcgtctgatatatccattggattacttgctccaaatggactttcttctcgagcgaagtttggtgtagattgtgcaggcgcttgataaggcgagttatagtcatttcctccagcaaacgagttgccagctgaatagcctccaccttgaccttcacgggcagtacggctttccaagagttggaaactttctgcaactacctcagtaacgtagacacgttgcccttgctgattgtcatagctacgagtctgaatacgacctgtaacaccaatcagagcacctttcttagcccaattcgccaaattctcagcttgttgacgccaaatgactacgttgataaagtccgcttcacgctcaccgttttgatttttaaaattgcggttaaccgccaaagtaaaagtcgcaacagcttgattagacggagtataacgaagttctgcatcacgggtcatacgaccaaccaatactacattattaatcatacaacaccttcttacgcgtcaagtttgacaatcatgtgacgaagaatgtcgccgttgatttttgacaaacggtcaaactctttaagagcttcatcgttgttagcttcaacgttaacgatgtggtacaaaccttcgcggaaatctttgatttcgtatgcaaggcgacgtttttcccatgcttttgattcaacgatagttgcaccgttgtcagtcaagatagagtcaaagcgtgctaccaaagcgtttttagcttcttcttcaatgtttggacgaataatataaagaatttcgtatttagccattgatatgttcctccttttggtctaatgactcatggtctagccacgagtaagtgagggatactcacagaaaataattataccataatatagaaaatgtgcaagtgaaaacaattttccgaaaacattttcacaaaaaagtaaattcccaaagtaagttctagtctgtcttaaaaactggaaattagactgagacaaagaaataaggtagaacttactatgggacaagttggtaactgacaatgaaaaacaaacacttaactctctctgatcgcaatgatattcaaataggaattgaacaacttaagcccttctcagctatagcagctaagttaggaaaagatccgtccacaatttcaaaagaagttcggagaaatagggtgataaaagagaactctagtacctccaattgtgaggcttgccctctactcaaaaagactccttacgtttgtaatgcctgtccgaaaaagagaagcaactgcggataccagaaacagttctactacgcaaaaagagctcagcttgattatgaagttaagctctcagattcgagaacaggtgttgcactaaacaaggaagaattctatcgcatggatgagattgtttctgctgccatccaaaagggacaacacctcaaccacatcatcgcctcaaacgaaatgtcggcatccagagcttctatctaccgataccttgaaaaaggctatctgtccacaaagcccattgatttcccccgtgtcgtgaaattcagaaagcggagaatcagaaacctacaacccattcctaaaatcgccaaagaaggacggtcttacgaggacttccaacgctttctcacagagaaaggaatcagctattggctggaaatggacaccgttactggacggatcggcggaaaggtacttctcacctttaacctctccttctgtaactttatcttcgctcaattacttgataataaaacagctaatgaggtcgctaaacatctctacgctatcaagaatgacctgcatcagaaagagatggacttttgcgaaatatttcctgtcattctgaccgataatggcggtgaattcgctagagtggacgatatcgaaatggatgttcgcggagaatctaagctattcttctgtgaccccaatcgttctgaccagaaggggagaattgagaagaatcacacacttatcagagatattcttcctaaaagaagttcttttgacaacttgacacaggaggacatcaacctggtttgttcgcatatcaacagcgtcaaacgagcttctttcaacggaaaatcagcctatgaactctttacatttacctacggtgaggaattggcaacacttttgggaatctctaaaattgaccctgagaacgtcattcaatcacctcgattattggataagtaatcgctagtttttatcaaaaaataatttcaaaatagaaaggaacttgttccatccaaaattccagatagctagaacttactttgagacgtctcagagccagtaactttagtgtactcttttttcaacattttcaaccctaaaactcactattatcaacatttttagtcaaaaacagaacttagtctgagactaaattctgttgatgttatgcagttttctcagagtaacttctggaaggacgggaactagaacttactttgagaatttaccattttcacaaaaaataaagactgcccaaacaaagggcagccctatgaattaagctacaatcgcttttgcgacttcttctgttgtcatacgcgagaaataatgagtagtatcaatctcttgaagtttagcaagtacatccgcatattcataacgtgtaccaactagtaagtcttcaacatcagctacatccccaataccgaagaagtcaccgtaaatcttgatggattcgatgacagatttttcagccttgatataggttgtgattttaccagccgggtaacgaacgctgcgctccacagtgtattctggtgtttgaccgtaggtccaatcccatgttgcaaactgcgaatcacggatttcttggattcgagccaaatcatcctcagtcaacacatattcatccatttctggatattcttgcttcatttggttgaggatggcatccttgaactccagaacggtcatcttatctggcaactcgttgttaatgttggtcacacgggcacgaacggatttaacacctttggactcgattttgtctttgctgaccttgagggcacttgcgaggactgacatatccacatcaaagagcaagcaaccgtggtgcatcatgcgacctttggcataggcttgggcgttaccacagattttctttccgtcgatttccaggtcattacgaccggtgaaattggcctctacacccagtgttgcaagggtatcaatcacaggtttggagaaggttttgaagtcaaaggctccctcgtctgccttatttgaaataatagtatagttgaggttatttaggtcgtgataaactgcgccaccacctgacagacggcgaacaacatggatgcccttttcgtctgtgaattccttgttgatttcttcaatagcattctggtgcttaccgataatgatggcaggctcattgatccagagaataaaaatttcgtcaatatctgttaattccttgaaggcataggcttcgagggcaatgttataagctgggtcattgctgttatttacaatgtatttcatgcaaaactcctttattgttaactaatttttattatagtggaaacgataacaaaagacaagtattgaaactcttcttgtccattcttgaattttctcaaaaatgatggtaggctataaaaggaggttttcatgagcaaacacttaaaatcatttttgatcttttatctagccgcaagcatctttcttccttttatgtggtttatcaatgcgccacttatctgctttgtacttcctctttatctgacctggaaaaacatccgccatttttgggaccttttgaaaaaacagttaaaagagtatagtttttggattaacgatggtttgattttctttttaggaacagggctaagttggttggctcttgaaatggctcaagttgtttacgtcgattggccagaaaccttggttaataaccagatccacagcccaatgcagaccgaagcctggtcagggcagtttttcctactccttttgggtgttttagcttatttggtgctaaacatcttccaaactaagctcctcccccctctcctaacggtcctcctcatcagctgcctatatccaagttttgtctttgctgttttgtggactatacaactttctagtttgattgaaacagatttcttcacctactgctacctgtgtttggttcctttcaatatttgtctcatttacagtcggacaattttacaaaccattcaactgtggcaagcagaattagccaagcagagcaacccacgctttcctagactttctgctctcctgcaaaaaagcctttctctgccaatttggctcctcttcttcagtcttccctatcttgcagttcttggctcctatctcattctctttggtcaaaaacctgaccagctacttcagatgtggacggaaaccagtgattgggccttgtcggaaaaaatctccccaccaaacgcattctatgatgaacactatctttgtacagtgggggctgctggtcaccgtaaactggtcaaacccattcgtatgggggaacgccatggacatcgtgtggtggtcaatcgtcagctacaaattgccaatgcttttgaacaaattttagaagaaagatgtccacgcctgcatcgttgcgttcgttccaactacgaccggtatggctatcccatttccaaacatattcgcaaagcttggcaggcggatctgatctatctgatcatgaaaccagccgaatggctcttcctcatcgtcatctatctgcacgatcgtcagccagaaaatcgcattgctgttcagtatttgccgctatcaaaaaatctattaccacaagaaaatactagcaattagtaatatatcacaaaaaagaaagccacatggactttctttttgcttagcttattatttgcgttttggtgggttgtggattgcaacaccaagaacatcaagaaaggcttcatacataacctctgagaaggttgggtgaccgtggattgatgctgccacatcatcaacagtcaattcagattccatgatagttgctgcttcgttgatcatttcagctgcaactggaccgatgatgtgaaccccaaggatttcatggtatttcttatcagcgataacttttacgaaaccatgggcttcgttagaagcaatagcacgaccgttaccagtgaagctattgcgaccgataaggatgttttctttaccgtatttctcgatagcttggtcttctgtcaaaccaaccatagcgatttctgggtgtgtgtaaaccgctgctggtgtgaagtctaatttagccttgtggtggttaccatggatggcattttcagctgccacttcacccatacggtaagcagcgtgagccaacatcttagtaccgttgacatcacctggtgcgtagatacctgggattgatgtttcttggtattcgttaaccttgatacgaccgcggtctagttcaaggttaagattttcaagaccagccaattgtggtacacgaccgattgaaagaagggctttttcagaaacgatttctgagccgtcattcaacttgattgtcaattggttgttggcttcgacgatttcagatacaccaacagatgtcaagaatttcatacctttcttagaaaggactttttgcaattcaacagacacttcgcggtccatacctggaatgatacggtcagccatttcaacaacggttacttctgtgccgtatgatgcgtaaaccaaaccaagttctacaccgactacgccaccacccataacagtaagtgacttaggaatttcacgcaagtcaaggatatcatcagaagtcaataccaacttagaatcaatacctgggatattgatgcgtgatactttagaacctgttgcaaggatgatgctacgacctttgatgaccttgtcgccgatgacaacagtcttgtcaggattcacttgaccaagaccgttgaagattgttaccttgttagctttcaagagaccttgaacgccaccagtcaatgtcttcacaaccttgttcttgaagtcaactgtcttgtccatatcaacggtatagtttgttgaagcaaggttgataccacgctcagccgcaatcttcaagccgtcaaggatttcagcgtttttgaggtaagtcttagttgggatacaacccttgttcaagcaggtaccgccaaattctgatttctcaacgatagcgattttaccgcccaattgagcaccgcggatagcagcgtagtaaccagcaggaccaccaccgacaacaaccatgtcatactcgtctgctgccaattcagccttaggagcttgtggagctgctgcaggtgttgcaggaacttccaaaccagctgctttcaagtcagcagttgcttgagcaacctcagctggagctagtgcagcacccacttcaactgattcgccttctgcaccaaggtaggcaatgacttctgttacaggaactgttgcaccgttgccatgaacgattttcaaaagaacacctgattcttccgcttccaattccatacttgtcttatctgacatcatctccaagataacatcgccttcgttgacaaaatcgccctcttgttttttccactcgatgatttcgccttcttgcatatctacaccaagtttcggcataataatttcaattgccatagttaagataccaagagcgaagagaaagcgactgaaaaataggaaatcgtagaaaatcctgattttctaaacgatttatcttttttccgagctttccgctcgggttcaattgctaaaactctctcgctcttattccctttctttattttttctctttaccaaattgagcacaggctaaaaacctattgaaaaagataaatcgcctcgtgcctcaaagcacatcgttgatttcctattttcatacgtttttcttaacgccttttgcatcttatctcagatcaacaattccaatgggttttccagcaagttcttcaagtcaaccatgaacttagcaccattcataccatcaatgatacggtggtcgatggttaagcagagtgccatgattggacggatcttgatttcgccgtcaataacaactggtgtttgaacagttgatgctacaccaaggattgctgagtttggttggttgatgattgggttaaaggttttagtaccaaacatacccaagttggtgatagagaaggtcgaacctgacatttcagcccccttcaacttaccagattgagccttcttgatgacatctttcgaagccaccacaaagtcagacaagctcatcttatctgcgccgtgaacaactggaaccaccaagccatcatctagacccactgcgataccaaggttgacgaacttgtgtaattcgatttcttgtgcatcgttaatcaaagatgcgttcatgtaacggtgttcttctttcatcaaagtacgaacaaccgcaagaccgatcaagtctgtaaaggttactttcaaaccagtcttgttcatgattggctcaaggacttgcttacgaagtgccatgaggttggtcatgtcaatatcgtagttaagtgtaaatgtcggagcagtcaagtaagagttgaccataccttttgaaatcgccttacgcattgggctcatcttgatgatttcaacgccttctggcaattctttagctggtttttcttctgcttttggtactggagcagcagtttctacagctacaggagcaagtactgcaagaacgtcgttcttgacaatcttaccgttgacacctgaacctgtaagggttgacaagtcaacaccttggtctgctgcaatacgggctgcaagcggagttgcttttggagctgctcccttgaagtcttcgacgtcaaccttgtggacacgaccgttagcacctgttcctggaacaagacccaagtcgattccaagctcacgcgccaatttacgcgcagctggcgttgcacgcaccttgccactaccttgtggtttggcagcagttgcaggagcaacgattactggtgtacgacccgcaggtacttcttcaatagccgctgctggttcaacagcaggagcagatgaagcgccggcttcaaccgtttcaccttcagcaccgatgtaggcaataacttctgttacaggaacggtagcaccgtttccgtgaacaattttcaataggacgcctgactcttctgcttccagctccatgctggtcttgtcagacatcatttccaagatgacgtcgccttcgttgacaaaatcgccctcttgttttttccactcgatgatttcaccttcttgcatgtccacaccgagcttaggcataatgatttcaatagccattattaagataccaagtccgaacagaaaacgaatgaaaaataggaaatcgtagaaaatcctgattttcgtaacgatttatcttttttccgagttttccggacgggttcaattcctttctttcagtttcttaccttgtcaagaaccaaaccagacttcgataatcgaagcggctcaattcttttccaagcattcttagtcatgctagaacattttatttctagcatattagggttatcgtctttccgattgcttttctgacaaggcgatttggtgcaggcataacttacgttaggcaagccaaatcaacacagccagaaaagataagtggatgacgataaaattaacccttgtttacttgcttatagattgccgctttgattttctctacgtttggcaatactgcgttttcaagaatgtttgcgtaaggaactggtacatcgtctgaagcgatacggatgattggtgcatccaagtagtcaaaggcttcgctttctgtgatgattgatgcgatttcaccgatgaaaccacctgttttgtaagcatcgttaaccaagataaccttaccagttttcttcacagattcgatgatcaattctttatccaatgggataagggtacgtgggtcaaccacttctacgctgataccttcagcagccacttcttcagccgctttcaaggcacgttccaacatacgaccgtatgaaataatggttacatcagtaccttcacgtttgatttcacccttaccaagtggaatgtagaaatctggatccaagttcacttcttcttttttaccgtaaagagcttttggctccaagaagataactgggttgttgtcaaggatagatgatttcagaagaccttttgcatcgttagcagtaccaggtgcaaccaccttgatacctggaatgtgagtcaaccaagcttcaagagactgtgagtgctgtgctgctgaaccgatacctgaacctgaagccacacggaaagttacaggtgttttcaaaccaccaccaaacatgtagttggttttggcagcctggttaacaattgcatcaagggcaattgtgatgaagtccatgaaagtcaagtcaacgattggacgaagacctgtttgagctgcaccaaccgcagaaccagcgattgcagcctcagagataggcgtgtcgcgaacgcgttttggaccaaactcgtccaacataccaacagatgtaccaaagtcaccgccgtagataccgacgtcttcacccatcaagaatactttttcatccttacgcatttcttcgctttgagccaagttaatcgcttcacgcaaggccattacttttgtttcagccattttttactcctaatttatatcaatttatctatactgaactaaggaaaaccaaacaattactacgatgtaattgtttattgtcccagcttaagacaccttagaattgtactcgaacttgagtaggtagtccaccctagtttgacttgctatttagagcttagtcaaacttcttacgtttgtagttaggttctgactagaggcttggaaaaatagatgagccattagtgatgtccacatcactagctgactctctaatttttctgtgcctctttaacgtcctcacaccctagtctacaaacacatcctcataagctactgagatgtctggatctgggctttcttgtgcgaatttcacagatgcttctacttgttctgcgacttgtgcttcgatggcatccaattcttcgtctgtcgcaatcttgttttctgtcaagtatttgcggtatttcttaagtgggtcttttgctttccactcattgacttcttctttagtacggtaaacacctgcatcggcagttgagtgaccaaaccagcggtatgattcaacttcgaccatggctggacctttacctgcacgaacgtactcgatgacttcttgcattttttcataaacagcaataacgtcgttaccatcctcaacataatgacctggaataccgtatgcagcagcacgttggtagaggtgaggaatcttagtagaataagaaatgtcagttgaaataccgtaacggttgtttgtaatgaagaagataactggcaagttccaaacagctgccaagttcattgattcgtggaaggaaccttcgttagtagccgaatcacctgagaaggcaataacaatgttatctgtaccgaggtattgttgcgtaagggccgcacccaccgcaagggcataaccaccacctacgataccgtttgaaccaaagtttcctttttcaacgttagccaagtgcatcgaaccaccacgacctttagatgtacctgttgccttaccagcaagctcagccatcatgccgttgatgtcaataccttttgcaataacgtgaccgtgaccacggtggtgtgagaagatgatgtcctcatctgtcaatccagcaataggtccaacagccgcagcttcttcaccgactgagaagtgagtcataccttgtacgaaaccgcgacgcactaatttgtttaatttcatgtcaacatcacggatttgttgcattttcaagaacatgtccaaatgttgttcttttgtgatagataccataatttcctccaaaggtttttctctttctgtactatgatagaccaatatttcacaaatggcaagtaattgaaccgttttctttttacagaaatttttgtgaaaaccttgatttagtgcgttttttcacaaatcattaaaagattcactttacttgtttgaaacttttttcacaaactttgaaataagcttgcacgccgtctttctttctgttaatataggtacggaggttcttatggaattcgatttatttcttatgatttgtaactacataggcactatcgcatttgctgtttcgggggccgtaaaaggatttaagaaaaagttagatatttttggaattagcttgctcggtatcattaccgccgttggtgggggaattattcgagatacgatggccaatcgcattcctgccgccttgactgatcctacagccatctatttatctctcggagtagcgattagcatgtacttgattgttatcaatctaaagcaggacaaaccacttgataagaagatgattcatttcctttcccagacaaaccttatctttgatgcgatcggtctagccatcttcgccctcattggagccagtactggcatctctctccaactaaacgctctaaccagtggtattctggcagctttgacaggtgtcggaggcggaatcacccgtgatttactcgtcaatgaaacacccattgttcttaaagaagatgtctatgctgtccttgcatttttctctggagtcctctatcatctttgcgttgtaaattggaaattaccacaaattccaaccttcatcactatttttaccatttctttaatcattcgattattggtaattaaatacaaaatcaatcttcccaatatggaaagcaaacgaaaggtctgagttcgtcaactcagacctttttgtattattattgattaccagccaccgtggccaccagcacctggtcctgttgctgtgatttgagtaatctgctcaccgttaactgtcacagtacctcctgtcaattcagcagttccgtcgaagtcaaaagcagattgagctgttacatcaattgtaccacctgagatataaatgtctccattagcatcaaaggcatccgtatctccactacctacagctactttcaagtcaccgccagttaccttgatgaagatttctgatgatgttgtacttgccgcattaatagcatcatctgaaccatagacatctaatgtaccaccattgatagtgatattagttccttccaaggcttctgctgattctgatactgtaatggtacctccgtcaattgtcaaagccgtctccgctttaataccatcatcacctgctgttacagtaatttcaccacctgtgatagttgtataacctttggtagtatctgtatcatttgtagacttgataccatcaccacctgctgttacattgattgtaccaccattgattgtcaatgaatccttaccacggataccatcatccactgcagtgacggtaatatttcctgaattcacgacaaggtcatctgtcgatacgatgccatcttggaagttgccttcaacggtcaggctaccattaccagtgatggtcaaatcagcttcaacatggatagccccttcaatattggtgtctgtatgattgctggtatctttcactgtattcgtcgtaccatctttgatttccaattcaacattgtcagcattaataacattgattgctgctgtatctgaacttgaaatctcagcacctgctagaatgatgcgaacattggcatctgtttcaaccgttacaccagctgttgttgaaccagttaaaatataggttccaccctcagtaattttcaagccatcatttgaaagcttcacttctgtcgttggaagggctgaccagtcaatagttgacgaacttgaatctgatgaagtgctattatttgaagttgtcgctacacttgtctgactagttgctgctgagcttgaagtagtcgttgaacttgaagtagatgaacatgctgctaagacaccaaggctcataagagtaacaccagagtaaagtaattttttaagatttgttttcataatgtagattccttttctttaggaagtcgtatcccttcctgatatgctcctagtttacctttccttcctaaaagaaagattaaagattgccaaaagaaaacttaaacttcttaggaactacaaaaggccgggaaacccagcctaggaataatcattgataaaatctatagcttaacccaatgcaagcttttcaactcaagcaagggagaagtttcaggattggtatctgattcagaaatccgttttaaacctggaatcatcgcattgtattgataaatgcgaaaaacaccagctccttcaaataagtatgttccatcctgtaaaggacgaagtagggcgtccggtccaatttcaaatccaagattgcggaaattatccaccaaacgtagactctcatcggcaagctgagtataaaggtcaattaagacatattctcccgacttgtccaaagctagaagcagctcctctgtaccatcatggttaacatcatacaaactataaaatattccactgtattcttgcccctggctagttaataagctcagatagctactggcctcatcctgattaattgcctcagcaggctgacccatattcgcttgataacgatcaataactgattggtatacttcacttagctcaggagtggtcactgaggatgcttgcgtctcggagctagatgctattgttgacgcttgctgcaaactagaaccatctgaaacttggcttgaagcactagaactagaactctcaccaccttttacctgattagactgacaagcagctaatagtacaaccgtggacactaacatcagtttactaataaatattttcataacttcctcctgtgctctatctttggtcttatactcttcgaaaatcaaaattatccgttgtcaacttgccttgatgagtgaaaagctccagtggaggttttcagcctgttaccatgaaataagatagtaacagagttctatcttcgacttcgtttcctagtctacttttgattttcattgagtattagtataacatctttccgagggcttgtaaacgccaccatatatggacaaagcatccgagccagaaaaagccgaatgttgccatccgacttttgttgttaatctttctgatcaagagcacgcaacatttggtcaattttattgccgtactcaattgattggtctttttcaaagaccaaatccggaattttataaagagttaacttacgaccaagttctctcttaatggttcccgtcgctttttcaagacccgtttgtgctttttgattatcggatgccaaattactcatgattgtgtaataaaccttggccgttgacaaatcgccgaccatctgaacatctgtaatagtcactccctgcacacgtggatcacgaactttcttttgcaaaatctcattgacttcgcgcttgatttccatcccgacacggtctgtacgaaaatgattcgccatattctttcctttcttagatgatagaaaagctgagtttccccagcttgaataatccaagtagattaaaaactattgctttaaaacctactaaaatctattaaattgtcacttcctcgacaaaatcacttgtctatgactttgacagtgagaaaatattattttttgatttcttccatgatgtaagcttcaatggtatcatcaactttcaagtcgttgtagttctcaatcatcaaaccaccctcttgggcattaccaacttctttcacgtcatctttatagcgtttcaaactagctagtttaccatcaaatactacaacaccatcacggataactcgaacacttgaatcacgggtaaccttaccacgtacgaccatgaaaccaccgattgttccaactttggataccttgaaggtttcacgaatgattgcctcaccaatgattttttcttcatattctggatcaagcatacctttcatggcatcttccatctcttcgataaccttgtaaatgatgctgtgaagacgtacttcaacatcatctgcttcagcttggctacgcgcttcagctgttggacgaacgttgaaaccaatcacaagagcatttgaagcttccgcaagagtaatatctgattcattgatagcaccaactgcagagtggacgatattgacacgtactccctctacttcaatcttttgaagcgatgatgcaagagcttcaacagaaccttgtacgtcggccttgataatcacattaactgacttaacctcacctgctttaagggtatcaaagaggttttcaagactaactcgttgcgttgcttgacgctgtttaagaagagcacgtttagcacgttcttcacctgctgcacgagctgatttttcatcttcataaaccgcgaaatggtcgccagccattggcgtttcgttcaaaccagtaatagataccggtgtagatggaccagcagttttaacacgacgaccaaggtcatttgtcatggcacgaacacgtccgaaggtatttccgacaacgattgggtcttgaacattaagtgtcccttgttgaacgaggagggttgcaaccgcacctttccctttatccaaatgagcttcgataactgtaccaatcgcacgaacagttgggtctgccttcagttcttggatttcagcaaccaaaagaacagtttccaacaattcatcaatgttttggttaaacttagctgagatttctacaaattcagattctccaccccaagcggttgagataacaccgtgctcagccaattcaccgatgacacgctctgggtttgcacctggcttgtcaatcttgttgatagctacaatgatcggcacattagctgcttttgagtggttgatagcctcaatcgtttgcggcatgacaccatcatctgctgcaacaactaggatggtcaagtcggtaacagatgcaccacgtgcacgcatagaagtaaaggccgcgtgtcctggagtatccaagaaggtaattttcttaccagcttcctcaatttggtaggcaccgatatgctgtgtgatacctccagcttctccagtagcaacacgagaattacgtagggtgtccaacaaggttgttttaccatggtcaacgtgtcccatgatagtcacaacaggtgggcgttctgtcatctcttcttcattgaggtagccctcttctacgaagaaacgctcaatatctgcgttatcgacctctaccttttctttcgcttcaataccataatcaaccatgaggagttcgatagtatctccatccaaagattggttttgagtcgccataactcccataaggaagagttttttcacaatttcagcaggttcacgtttgattcgttttgcaatttctgcgacggtcatgccagcagtatattcaaattcagttggcaattcgtggaacttgcgttctgtgacaggtttggcaggttggttagccttgccttttttatttttcttgttgttattccagttacttgttctttgatttctcacttgattttgactatttcgatttctttgttgtttccgtggaccatcttcttcgtcactattaaagtcacgttttttatctggtcgagcttgtttcttacgacgggtatctacagtagtttctgcaacttgctctggtaccgatgcaacaagtgcaggtttcacaaatggtttgctttccacaaccggttcttcaaacttaatttcttttggcttcttaggttgctttttagcttcctgagcctgacgaaaacgttcttcactggtacgagcatactccgcattttgttctgctttcaaagcagcagcacgcgctttgaagtcaattttaggtcctgctggttttgcagcctctctttgttcaaagcgagctaaccgacctgaacgattgtcctgacgacggttgtctcgattatcgcgacggtctccaaatcggttgtctttccgctcttctggacgctggtcacgacgattgtcgcggcgatcatttcgctcattgtttgaacgtccctgacctagttgacggttgtcacgacggtcctgatcagatttagcttgaccaccttttccttgattctgagctcgcttagcagcctgctctttggcccgtgcttcacgctctgccttaaagtttcgactctgtggacgatgtgaagctgattgtactgcacttgccgcaacttcttcttttactactggctgtgtttccttagctttttctaccttagctgtttccacttttggagtttcatcaaccttctcaggcttgctaacttttgccgcaactttagttgcctctgatttttgtcccccaaagctttctgcaaggcgtttagcacttgcttcatctacgcttgaagcatgacttttgacttcaaaacccaattcttgagccttagcaacaacttccttactgcttacgcctaattcacgggctatttcattcaatctcttcttagacaatgccttgtcctcctgttctattccataatagacctcatcttctttgtaaatccagcgtctgtcactgcaagaacttttctagccttgccgacagctgcactcaattccagtgttgaaaacactgttacaacttctacttgataggtatgacttttatctgttacttttttacttaaatttccagcagcatcttcggctaaaaacaccaactttgcctgccctttttgaatagcttcaacaaccaggtcctcacccgaaaccaggcgaccagctcgctgggccaaacctaataaatttaagatttgctgtctcttattcgagtccaagttctctcctcttgatcttatgatcaacataggcaattaattcatcgtaaaattcttcggccacttccatactaaaggaacgatcgaagacacgacgtttcttagcttggcttgcctcatcattgtcaagcttgatgtaagctccacgaccatttgccttgcctgttggatcgataaatacttgaccttctttattttttacaatacggagcaaatcccgtttgtcgatgatttcaccggacaccacagacttgcgcaagggtatttttctagcttttgccatggttgctccttttgccttattcttgttcttctgcgacttcttctacaacttcgtctgttgcatattgagttgcttcaaaagcttcatactccgatgctgacttgatgtcgatacggaatcctgtcaaatgcgctgccaaacgaacgttttgaccacgacgaccaattgccaatgacaacttatcatctggtacaacgactgtagcatgtttcccatcttccgtgtcaaacaatacttggtcaacttcagcaggtgcaagggcattgtagataaattccgcttcatctgctacccactcgataacgtcaatattttcctcagtaggaatcatacggtcattcttagcatcataacgagctgggtggaatttgctagtgattttcttaatatttgaaccaccacgaccaacgatagtaccaatagcatctacgtttggattatggctacgaacagccactttcgtacggtctccagcttcacgggcaacactcatgatttcaactgttccatcgtatacttctggaatttcctgttccatgagacgtttgatcatttctggatggctacggctgacaaatacgttaacaccacgaccattgtcttctaccttgtagacatagacttcgatgcgatcatgagattggaaaacctcaccaggaatttggtcttgttttgacaattgtgcttcaatcgtaccaaggttgacatagataaagcgattatcaaaacgctctaccgtacctgacataatctcattttcatgttgcttgtaggtattgaaggtaatggcacgcttttgtttgcgcatcttttccatgatggtctgtttagctgattgagcagctacacgtccaaattccgctgggtcttcttggaatttaattttgtcacccatttcataagctgatgaaatagccaaggcatcttttagactaatttctagtcggctatcaaatacttcatctactacttcacgaacagtaaatacatggaaatcgccttttttctcgtcaaattcaatcactgctgattctgattgaccataacggcgtttataagctgaacgaagcgactctgtaactgcatcaatgatatccgctttgttaatacccatgtcttcctctaaaatacggaaggcttctagcatttctttactcatgttgttttccttttgcgctcaaaaggtcctttcttaaagtctaatatctttataaaatactcatgaaagagcattataacttaacagccaaacgggccttagccaccgtctggtaaggaatagttacttccttcttacgagttttatccatatactccataatcaggtctgttccatcaaaggagagcaacgttccttcaaaaaccttgattttatcaattgcctgatagagtttgacatggatgtactttccaaccgccttctcaacagcatctgccgtttttaaaggacgttccaaacctggacttgttacctccagcatgtattggtctggaaatgggtctggtttgatagtgtccaaaatcggactgatcttttcggataaatctgccgtatcttgaagggaaattccaccctccttatcgacaaaaatcgataggacatagtcaccgcccattttaccatattccacatctaccaactcgtaaggagtttgaatagcgggggtaattgctgctgtgaccaattcaataattgatgacataaacacctcctatttttacagtcgctagaaatacattactcaaatagttcgcactatccaggactctctatttcctttgacagtaaactcccttgtactatcattcattctatatacagaaatccgtgtacagggaaagggttgactgacgccaaccccttttctcattattcacttccattattctatcatatctatccctatttgtaaaggaaaacgatggattatagacatttataatcttttagtttacttttagtactctctccaaaggtttggggaacctttggaggttggagatagggcgaagcaagttcacttcaatagctgcagacagcttgtacagtcgagtgactgtgcaaggttggagatagcccttgcggagcaagtcacccctgaagagtacggcaaagcgaattcaaacaatccagtggagtgtttgaacttagaaataaggaaacggaatttcctcttacgtcgaagtaataaaagaaaaactgaatgactatagtttattcgacaaaggaaaaaggtctctgttagacctctcctcattttccactaagggaattattgaaactgtgcttccacacgatagatgacttgacccttgtttgagaatttctcctcatactctgtcataacgttaccttccaaaccatccgcatgcaaatctagccaaacctgcttcaagaccatgccatattgagaaaaactagccaggctatactcaaacagaccacgattatctgttttgaagtggatttctcccttctcaggtaggatttccttgtaggtatccaagaatgacttgtaggtcaaacggcgtttctcatgacgtttcttaggccatggatctgaaaaattcagataaagctgatctatttctgccggtgcaaaatagttggtcaaactcgaaccatccacctgcaataattttatatttggtaaaccagcttcaagcacacggtccaaggcatagcttaacacggtcatctgaatatcaataccaatatagttaatatctggattttgcgcagccataccagtgacaaagcgacctttaccagaaccaacttctatgtggataggattattgtttccaaaaatctctgcccatttccccttacactcctctggattggagataacatactggggattgtttgctagaagctcactcgctcccttacgatttctaactctcatacttccttatagaaactctgacggaattgccgtagagcataaatttctttatttgcagccaaaacattgtagctttctacatgcttagctatttggtttagatagccaagctggccataccaataaaccttatttaatactgtgctgttatatttgtagccataagcccgaagccactcttcccaggactgacgaggaatataatgcgtcaaaatataggcaacatccaacatccgatccgttacacaagcggtctcccaatctgtcaaatacaccaaaccagacgtcgtttctacccagttactatgatgcaaatctccatgaacaaatgttgccacctcttgacggaatcttggtagattattcaataaatcttgacagatagattgcagataagaattctgtcccaatctagttggtgcctctttttgccaacgataaaccaaatcctgaggttccatataggtataattcatctgcaaagcctgattgagcaaaatgcgagaatagtgcattctcaccagtatttgacgaatctgtttactagtcatatcttgacgctccaaggtacgaccattcaaccactcctgctctacacgatgccccattcctacttcacgatttgctgacaaaacgggtggtgtaatttgctcacgcgcaagagcagacactatcggaggcatctcatacttcacaaagactggcgttccgtctgaccgtaggcctttaaacgctttgccactatttcctgcaatagactgtaattgtagcccactggtatcaaactgcatgcctttcctcctttaaaaattccttactattttactaattttcgtctatttagtcaatcaatttttttaattttagaggcaaatatatttcatgcaagaaaatccccacgagaagtaagacgactaccatcgcattctctttagaaaatagcagagcaaagcccaattccactactaatagactatataaaatcactctaagcaaattctgaagaccaattttcttggaatctttctccagaggatacagttgtgttatatattgataatcataatgcttgtaaagccccaacaactggaagacaagcaaataatgaaagactaaaactaggccgatggataaccacgattcttcaatggcaaatagggacaaaatcgccaacaacagtagacgtatcgtcaagcccaagtagtctcctgaacgcaagaaagcccgtaagtagagataaaaccaagtctgtctcgacttgacgagacgcaagattccattgagatagcttctcggtttaacagtcgtaccgattcctttaaccgttgtaaataaggcaaagaaacgtaaaatagactgtttccttttttgttcatcttgaatagccttagaccagtccaatactccctgtgactgataagccactaattggcgcttgacaaaaagacattttaaaaccaacaaagtaagaagaccagatacaatcatccacaccggtaaacccagtttcaaatagattggtaacaaaacaagctgaaccaccacctgtatagaggaccaaaacaagaccgtgcgtctggctgcaacctcgagtccttgcagaatgtctttttccttggtcaataggaagatttgatcagcttcttctaaataagtcgcaattcttccggacaatagcaccagtagactgattgcaataaccaccaaaacaatcggcaacggattctcagggaatgacaacaataattgacgatattgcaaactcaaaaagcctaataaaaccatgagaaccaaaacaaaatggtcattcagaacatagcgcagatacttggaacaacgatttaaaaaatctagtcggcgttgttgaaacaattctttcatccagccactccttcttgcgtcaaggccagataaatttcattcagacttgcaccatccataccaaatgcgctttgtagctcctccaaatttccagttgcacggacctgtccctgatgtaaaatcacaaaagagtcgcacattttctcagctgagtcaagaacgtgagtggacatgaggattgaagtgcccttagatttttcttcccccaaaagagcgattaaatcagagatagccacagggtctaatcccagaaaaggctcatcaacaatcaacagactcggctccaccataaaagcacaaataatcatgaccttctgcttcattccctttgaaaaattgacaggaaaccagtccaatttctcatccaagcgaaacagttttaacaagtgctcaacacgtccccaagcttgctcccaggataaatcataggccattgctaccacttccaagtgctctttgagggttagttcttcatacaaacttggtgtttcagggataaacccaattttcttccgataattttcagccccttgtagcaaagttaggccgtcaattacaatctgtccttgatagggtgtcaaaagaccgataatttccttaatagtcgttgatttccctgcaccatttaaaccaattagaccaactaattgaccatcctcaacggtaaaagatacatctttcaaaactgggatattgacatatcctccagttacattttttacttctaacatacatttcttcctataatttgatataattattataacaaaaatcctagaaagaggttgccattatgtcggattgtattttttgcaaaattatttctggagaaataccagcttcaaaagtctacgaagatgaccaagtattagcctttttagacatcactcaggtcacaaaaggacacacattggttgtccctaaaaaacactaccgaaacgtgcttgacatggatgaagaagctgcagccacactcttttctgttgtgccaaccatcgctcgtcagttaaaagaaaaacttagagctagcggtctaaacatcgttaataataacgaggaggccgctgggcaaaccgtctttcatacacacatccatctcttaccacgctttaacaatcaagatggattgagcattcaatttaaagccaacgcccctgacttcccagccctggctcaactggcacaagagctctatctaggagaataatatgaaacttcgtaatatcattttagccgtaagcgccgctaccgccagcttccttgcagtcacgcatcgggataaaattaccaaagaaataaaggaaaccaaacaacttctatcagatattcaactgagcaaggacaatattcaggaacaacttgccattatccaaagttttcaagagcccttgcaggaaatggcttctgacttacaatataagactcgagtctatcagcaaagtattgcaggaaacttggaagaaatccaacagattctcaaaaaataccagaatgagaataacactccctaacatctggaatttccaaatatataaaaatagaggttgaaaacaacctctatttttataggcttttagtactcgctcgtcaaagtaataaaagaaaaactaatgactacattattgtgccccgttttcatcaccgagtactggctctgttgaaaaatcggttacctgctcttctgttgtcacagtcgtagtagccgatggactccctatttctggatccaagctttctgcccatggacttgcttctaacagcaagagatttgtatatgcatcataaacgtttattggacttggcaatcccatctgtccttcgtagaccttcacgtttgtgactaagtcggtcttttcttctaagccgatagattttttcagaacattttgcatttccaatagatgtgtactggttggtaattgataatagattgcatcaaccatttgatccacaccgcgcaactgataggaattcaacttggagacagagtccttgtaccccaagagatttggaattgttacaggactaatctcaatgttggttcgcatattattagaaatggcagtcagaatcttcttatactgggtaaaaccgtctaactgaaggagtttttttataatagccgttataacttcacgttgacgtctctgacgaccaatatccccctcaggatcatcatagcgcatccgagcataaaccagcgcctgatccccatttaccaactgtttccccggctggacaatagaggtgtaggcaggctcatgttccgaaatggatatagggaagccaagagtattgtttacctcaatacctccaaccgcatcaacaagctcaaccagaccatccatatttatttcgatataacggtcaatgttaatatccatcatcttttcgatcgtggcaatggccattggtgcctgtccgtagctataagaatgatttagtttttcaaccgttcctgaagactccccattcgcttctgcaatctcaaccataatatcacgagtcaagctcatcatattggtttccttagtcttgggattaacagttaccaaaatcatcgaatcactacggccaccctcccaatctcccccgcgggtcgcttggtccatatccacccccatcagtaggatagttaggggctctgtcgcatcaatcggagttattttttcttctccatctagctgcttaaatgttttcgaaatagcatccgtagaaaaatttaacaagctggctccatatattaagccggcacctactgttaaaccaataatagccaaagacattaagaatattttttttccaattgtcatacttcaccaattaacttgcccatataataaagatcaagccattctccttcatctgttctagccccacctatctgggttccttcaatgttgaatcctagtttttggtataaatgtactgccgcctgattgcgaacctgaaccgttaattccaaacgcttcaatacatccatttcctctgcccaatgcaatacttcctccagtaaaatcgtccctataccgtgaccccagtaggctttttttactgcaataaaaatatttccgatatggctaatgcgaaactgcttagaggacttaacagaaattgcgccgacgacttccgaaccaaccttagccaacaggcacaattcacgaggattttcgatccctgcgtcgaagatggtctctatttcatcaacactaaatcgaaaaccagtctcatccatgactagataatccgtttctctagcaacttgattcataaaatcaataaaagctgctgcatcagctggttcagcttcactaaaatacacttctttttcagacattttggaactccttcgctaaatcgctactttgagctccatgagattcgactgtcaatcgtcgaccatctccctctttctctatacgaatgagcaaatagtcatcaaatagactgacatccagtaattctccccactcgataaccgttagacctcctccatagagaaaatcatccaaatcaatcgagtcagggtcatctccaattcgataaacatctaagtgatagagcggcatggccccctcatactctcgaacaatcgtataagtaggactcttaatcatctgttcaatttttaaccccttggccaaacccttggtcagagttgttttcccagcacccaaatcccctgataatactagaacttgatttggcttacaggcctttccaattctctcaccaatggcaatcaattcattttcattctgactatacatgtctttaattataccatagccccagtagtttgtcataggtctactggaaattgtagacaagtcgacagaaaaaatcgcaagccagagcctgcgattttgtttattctacgctgaaaagatatggatagactggttgatttccttgatggatttcgacctcaacatcttcaaattgttcttctagctgttcagcaagagtttgagccaattcttcattaccatcttcaccgatgtagatagtcacgatttcgctgtcttcatccaacattttatcaaaggtagccacaagtgtctccatcatatctggattagaaaccacaatcttgccatcaaccataccaaggttgtcattctcatggatttcaagaccgtcaatggttgtatcgcggaccgcagttgtcacgctaccacttttcacctctgcgagagatgccgtcatcgcttcaaagttgctttccaaatcacgacttggatcaaaagcaagcaagctagtaaaaccttgtggtagggtcttagtttccacaaccttaaccgcaacttctgcaacctcagcagccgtctgagcagccatcaagatatttttgttgtttggcaacaagatgacattgcgggcattgaccaattcaatagcattgacaaaatcttctgttgatgggttcatggtctgaccacctgaaatcacatagtcaacgccttgtgatttgaagatttctgtcaaaccttccccagcagctaccgcaataatagcatactctttttgttcagccggtttttggaaactttctactttctcaacctgagcttcatgttgctcacgcatattgtccacttttaccttgaccaagctaccatattgaagacccgcttgcatgaccaaacctggatcttctgtatggacatggactttaacgatttcatcatcgttgaccacaaggagggaatccccaaggtcgttaaggtagttacggaattcttcataatcaaagtccttgacataagtaggcccctggcgaagagctaccatgatttctgtacagtaaccaaaggtaatatcttcagtcgctacatgacctgcaactgacttgtggtgctcagcattgatcatttcagacataacagcaggtgtcgcctcaaaatcttccgaagcaatatactcacccgtcaaagctgacaagaagccttcataaatgtaaacaagaccttgtccacctgaatcgacaacaccaacttccttcaagactggaagcatctctggcgttttcttaagagcacgattagcaccgtcaagagtggcacgcatgacctcaaccgcatcatcagtctcttctgcctttttcaaagcggcagtggctgccccacgcgaaacagtaagaattgttccttcaactggcttcataacggctttataagccacttctacaccatgttgaaaggcttgcgccaaatccttaccgtccaattcaaccttgcctttaacagattgaccaaaaccgcggaacaattgcgacgtaataacacctgagtttccacgagctcccatcaacaagcccttagaaagaatttgcgcaacttctccaacagtagaagcagacttatctgctacttctttagcaccattggtaatagtcatccccatgttggtaccagtatccccatccggaactgggaaaacattgagtgagttcacatattcggcttgtttattcagacgagttgatgctgcctgcaccatttcttgaaataaactagttgtaattttagacacaattattctcctacgactttgatattttggataaagacattgacggcatctacagagatacctagttgattttccaagttgaacttaacgcgttcttggatgttgcgagatacttcactgatttttacaccgtagctcatcacagtataaacatcgactgcaatgcgaccatcttccaaggtcttaatcacaacacctttagaataattttcttttctcaaaagtgcttgaaaattatccttgatcgcagacttactagccatcccaacaacaccgaaaatctcagtcgtagcaccgccaacaactgtggcaatcacgtcatcagtcaattcgatttggccgtctttagtattgattttaacagtcataattcgttacctcaaatagttttatcactccattttaccacattttctgctttctgtaaaaaacaagcttgttacatcggattttacaaaaacatactaagattagtagtgaggaaatctccgacgggagaaagtactcactactttttctttatgataaagtagaggtgtcttgttaagtcgagaactcttttgacgctagacgtcgcaacaaaaactggcaagacacctgttttagaaagaatgttatcaaagtatgtgggacgccagacgtcgagtattgaaaatgacatcactaaaacaaggaatcattcaagacaaagaggtaatatcatgcgagtagtttttgggattgatgtgagtaaggcaagttcagaagtggccattctagtcaacggcgagaaggtacataactacaccatgtccaatgatgccattggcttttctcggctacttggcgatttgaaaaccgtccacaagccagaaatcatctttgaagcaacaggcgtctattctcgtcgtcttcaagcttttctggatgaacatggctacgcttatacacgactcaatcccttagaagccaagaagcaactggatagcttgcgtgtgcggaaaacaaatcaaattgacgctgaaaaactggctcaatctcaatttgtgctgaatcgtaaacccacttatgtccaagaagaagtctaccaaaacttgcgggatctcagccgtttctatcagaatctgaccgaggatattgttcgagctaaaaaccgcctgcacaaggtcttacaggtcactttccctgaattggaaaatatcttgtcaacaccatctggcgaacaatactggaacttagttatagcttttccttgcaaggacttcgtgcttgagttaagcaatgatgaactctcaaagagcatccgtctgtccacttcaaaacggatttctgataagcgtgtggcttacttagcagaaaagcttatagcactagctaatcaatcttattgtgccgtcaagaaaacctctccaatactggaagaggtccgttactatgcaaagactttatgaacagagacaagctgtcttagacgaaatggtggaactagctcagccattacctgaatatgacattctgctctctattcctggaatagctgagactactgcaacaagtattattggtgaactgggagatattcgccgttttcagtcagccaaccaaatcaatgcctttatcggtattgacctgagacactatgaatctggtaacttcctcgctaaggaacacattaccaagcgtggcaatccctacgctagaaagattctgttcaaatgcattcacaatatcgcttcagccagtcataccaatccttgccatatcgcagacttttatgagaaacgaaaaagacaatcgcaaacgacttcaacgaagtcgcacacgattgcctccatacatcgtctcattcggacaatgtattacctcattatgcataacaaactttacgattacgcttcaactcaaaatcggtaaaactgtttatgccatatcattgtaacaccttatcaaaaaatttcaacataaggtgttggttttgtatgcactttttacactaaaatttagtccaaaataaaacaatttccttattttgactattgaactcaaaatatttttcgtcaaataccttgatggacttgacaaatagtagaaaaaagagttcccaaaggaacccttttcacaattaacctaaacgctgcttagcatctgctgcacgttggaaagcttgtccgacatagttgatacagagcatcatcacaaggatgaagatggctgctggcaaccaaatccatgtcttgttttccaaaatatctgcattgcgagcattggcaatcaaggtacccaaacttggtactgtcgatggcagaccgaaaccaagataagtcaacgaagtctcgataccgatatttcccgcaaagttcaaggtcaagttaacgataatcaatgaacttaagtttggtaaaatttcacggaacataatcataaagtcgcttgttcccaatgtttttgatgcatttacatagtccaaacttgcctctgacaaagtccttgtacggaatagacgagccttggccgtccaataaaaggcactcatgatgagaatgaaatgatagattgtatagttcttgataactgtcacgaaaacaataatcaacattgtcaccggcaaaatcatgatgaaatcgacaatacgcatcaagaatccatctaaacgaccgccataataaccagaaatcagaccgacagaaatcccgacaatacttgtaataatcgtaatggtaaaaccgataatgattgagttacgagcgccgataatcagctgaccaaagatatctttaccaccttcatctgtccccaagatatagccgtcaacacctggttccaagtaacgtcccaaaaggttgactttcataacttgttcttgattcaacagaagtgcaccgataaagactgctaagagaaccgtcactaagataattaatgaggtcaatgcaagtcgatctttcataaactcccgcgcgatgacacggaagccacctggaggagttgaagcagattgtacttgttttttattttctttactcaccttactcctccttctatttcacacggatacgtggatccacgatactcatgataatatctgaaatcaatgtccccaacaaagtacccataccaaataccaacaataaagctaagataacactatagtcacgactagaaatagagttaaagaataactgaccgatacctgggtaagtgaaaatattttcaataaagatagaaccaccaattaatcctgtcaattcatagcccaagaaagatgcgattggtaaaatcgaattacggaaaatatgacggttataaacaactctctcaggaacacctttggcacgagctgtacgaacatagtcctgactcttagcatcaataatccccgtacggagatattgaatagtaactgttgttgacaaaatagccattgtaatcgctggcagaatcatatggtgtaaacgactgagagtcgctgcaaatccttccacacctccactaatcgaaccacgcgtcgggaaccagcccaaactaaagccaaacatccagagcatgagaatggcaaaaacgaaagttggagttgaaaatgtcaagaagttatacacgccaatgattttatctgcaagtgagttttgataacgacctgcaatcatacccaatggaagtgcaatcaaataagtcaataccatcgtcaagagggataatccaattgtattattcaagcgctgcatgatgacatcaacaactggttgtttaaaaataacactctgaccaaaatctccttgcaaaagattgcctacccagcggaaatactgaacagggattgggtcatagtaacctgccgcaatccgtttttgttcaatgattgctggatcaatattggggtcaatcaatcctgtaaagggatcccccggcatcatcttcgcaacaaagaacgcaatgacactcaaaataataatctgcggaatcatcatgagtaaacgacgtaatactgttttccacatcttagttctgacctccttctggaagggctacttgatgagtttctgagaaggatctcaaatcgtacacacgaccgttttcatcatagtattgaccttgcatttcttgatattctttttcagcagccaaacgcttttctttattcttcaatcgattgagtgggtcaatcgttggaatagctgacaacaaacgtttagtataaatgtgttgtggattattataaatatcgttcttatttcctgtttctacgaaacgtccgcgatacatgatgaacaattcatcacacatgtgttgcacaacaccgaggtcatgggaaataaagagatagctgagcttaaactcatcttggatacgtttcatataattcaagacctgtgcctgcacagacaaatccaaggcagaaaccggctcatctgcaataatcaaacgaggattactagccaaagcacgagcaacaccgatacgttggcgttgaccacctgagaattcgtgaggatacttaatcagagcttcttcatttagaccgattgtatccaagagttgaagaacttttttcttttcttcatctggagataaacggtcaaagttacgaattggttctgcaatgatgtccaagatacgttttttcgggttgaaacttgaaagagaatcttggaaaatcatttgaacatcacgattaaagtttccttttttaccacgtgatttgttggttacatcttgtccttcatagataatctgaccagaagtggcacgctctaaaccgataattgccttaccaatggttgatttcccagaacctgactcacctaccaaaccataggtttttccttcttcaaactcaatattaacaccatccacagcatagacatggtccgtcacacggttaaagaagccactacgaattggataatggacttttaaatcttttacttcaataaatcccactattaggcctccccttcaaaatagaatgtctcatggcaggtacaacgaacaaagtgatttggacctacctcgtgcatgctcggattctcttcatgagcctctgctccaatccacggaatacgcggagcaaaacggcaacctttacgaaccatttttgtaatcggcggcacaataccttcaataacatgaagatcgcctccttcgctacctgattgaggatttgacttcaagagcgaacgtgtatatggatgtttaggattggtaaacaattcttctactggcgctacttcgacaaactgaccaccgtacatgaccgccacacgatcagcagtttctgcaactactcccaagtcatgggtaatcaaaataataccagaacctgtctccgcttgaatatcatttaagagatccaagatttgtgcttgaattgtaacatccaaggctgttgtaggttcgtccgcaataataattggcggtttacaagacaaggccatcgcaataatgatacgctgacgcataccacctgaaagctcatgtggatactgtttaaatgtccgcttaggatttggaatacctacctgagccaagagttccaaaactcgctctgtacgagcattggcatccaaatcagtatgatagaacagtgcctcatcaatctgtgcaccaatcgtcatcaatggatttagagaagctaagggatcttggaaaatcataccaatatcattaccacgtactgtattgtacttagcttcatccatgccaatcaattccatatcattgtactggatgcttcctgtgattttggtattcaaagggttatgcaagcccatgatggtcgttgccaaagttgattttccacagccagattcccctacaattgccaaaatttcatttttttgcaatgagatgtcaacaccgtcaacagcgtcaaaataatcatctccaatacggaaaccgacgtgtaaatctttaatgtctaaaagcggtttttcggtagccacgctttttcctcctttatgtgccagctaatcaagctcaatcaattcaatagccttacgattatcaagttcatataacgtttgattaactgactttatataactactctagaataacatatttctaccaaattatcgtttgatagcgattacccagaagtaaaaaatgtacctatatccaatcataaatcaagaccatccctatcactgtctcaattaggaattgagtaggttaatgttcttcatcttgagtttttgttagtagggactcatttttgtgtactgagtctactataccacaattatctgaaaattccaatagcaatctgaaaaaagccaatcaaattggctttttcagattctattgtcttctaacaaattattctgccactacacccttatcagctgtcaattcgataccctcataagcaagacctgtacccgaagctgagccgtattttgtatcatagcttttcacacgtttattaacagcagtaattttttctgactcaaacgttggaatagcaaatgcttgctcgtgagcatatttttgccaagccttatagttctcaacgtttttcttatcatcaaacgactctgctgagctgatagcttccaataacttggtgttttcatcggacacgaaacgtgacatattgaaggctgcgataggcccccatagaccacttgggtttggatcgtaacctgttgaccatccaccagcatacatatcaatagcagcatcattagcctgaactgagttatagaacgacttaccttcaactgtacgtcctgtgtaaagttcgacattcaagccaacttctttccaccaagcaatgtattgttgtacaagcgcttcgttagcttcagtacgtttacgagccgcaaaggtaatcttgaatgccttaccatctttgccttcacggataccatcaccatctacatctttgtagccagcttcatccaaaagctttttcgctttttcaggattgtatgaatagccttccaactctgaatcatgaatatcgccgaagaatgagataatcaatgattttgcagggtggtaaagaccgttgtataatgacttaccagctgtcttggtatcaatcgcataggcaatcgcttgacgaagtttcacatcattcatcttggcattttcatccataacgttcttaccagctgcttcgtcatatttaccaaaattaaacgagatatactcataagacgactctaactgaccaacgatattcaagttagaagcatccttatatgaatctaactgatcaaccggcatttctgcgatatcataattccccgctttcatttcagaaacaatagtatcaggagatacgatgtcaatcttcaatgagcttgtttttggtttcgtacccttgaagaagtattcgtttggtacgtaagtgatagactcaccattgacgatttccttaatcttccacggccccataccaacaagcttcgcagtacgtgagtattcgctcttttcccagtctgcaacagggatgtctttatagatgtgttctggttggatataggctgggacatcaccacctgcatacatcattgaaggtgacatttcttttacagttaattctactgtatagtcatcaactttcttaataccagagatgtctgatgcttttccatcaacaaattcttgcataccttcaatattcaagaatttatcatcaaaacgaatacctgtatagtctttgcttgccatcgacttaattgtaaagatgtagtcgttgattgtgaatgactcaccatctgaccacttgtaatccttaccagtcaagctgactgtgattttcttgccttttacatcaaattcagccttggcaagacctgagtcgtccaacttacgttctccgtcgtaaccgaacattgaaatatcaaccataccaccaaatgttgaatcagtagtattctcagtcaactcatcaattaaaagacctgatgaagttgtaggagatacccaagcatatttcaattgagcatctgcgactgctgttccatcttgttttacttcagccgggaatgacaattcctgttttgctgcacctgattgttttgaaccacatgctgcaagaacagatgctgaaaggagagtcacacctgcaagtgcaaaaagtttcgttgtctttttcataaaacacctctgttttctttttgtttgacacttattactatgtcttataaaaatcattatatcataaatttttcttaaataaagtctttttgtcagaaaattttgtaaaaacatattttttcatcattttctcattttttacatgttttttccaaatttttctcacatttcttgtgatataatagaataaaataccccaaaaaggaatgattatgcgtaaacttttactaacactcactacaatccttgctgtttttttaacttccacacctattttggcagaagatttttctgttgcagccaagcatgctatcgcggttgaagtaagtagcggcaaaatcttgtatgagcaagatgccgaaaccaaagcaagcattgcttctatcagtaagacattgagcatttacctggtctacgaagcactggcaaagggggaaatcactttagatactatggtagatatttctgattatccctatagcctcacttctaatactgaattaagcaatgtcaatctagatgaacgctcctattctgtaagagacctattaaacgcttctttaataacatcatccaacagtgctattattgctctggcagaaaaaatagccggtagcgaagctgcattcgtggatcgaatgaaggcaaaagtccaagaatggggaattaccgatacaaaaattgtcaatgtatccgggctagataataccgacttgggtgaaaatatttatccaggttccagtcctgaagatgtaaatatgttttcagccctagatgttgctatcatcgcaagacgattaatactcgactatcctcaggtactcgacattacctcgctaaacgcctacgattttggcggctacacttactatagtaccaaccaaatgctgagcgacggcactcacgctcgtggaggggtggacggcttaaaaacagggacctcaaactcggctggttcaagttttcttgcaacaactcaacaagctggtatgcgcattatcacagtagtattgaatgccaatgatgggctgacctctccagaaaatcgctttgtcgcgacaaatgatttgatgaactatgtttattctaacttttcgcttgttacactagtaaaaaaaagtgaagcctttggagatagtaagataaaggttttcaacggtgaaaaagaaacaagtcctgttgttgcagcagcagatttaactgttgttcaacgaaatcaaactgataatgtccccaccgcaactttcacaacggatatcaaagaaattgatgctcccctcaaagcagggaccttggtcagcaaactacaactgaaagatcaagatctcattggaaaaggttatatttccgagcaaactggtgtcgatatgattatccctagcgatatgaaagaagcatcctggccattctcttggtggaatcaatttgtccgctatgtcaatgaaaaattataaaaaaatagtatgtcgaacgattttcgacatactatttttttattgtagagtgacaaccgctactccttatctccagcctcggttggagagtgagttggtgagagttcctgacagaaaatgacgagcgtggaaggtaacaattccattcgtcaatttataaagaagagctactgccgtcgctcctcatctcctacttcagtggggagtttgacgggcttgaacagctttaaagctgttcaagttcgcggcaaactatcccactgaaccctccatctcataggcaatcagtctgttgagttcgactgcgtattccattgggagttcttttgtgaatggttcaacaaagcccatgacaatcatctctgtagcttcggactcggacaagccacggctcatgaggtagtagagctgttcttctgagatttttgatactttggcttcgtgttcgagggccacttgtgagttgtggatttcattaaatggaatggtatctgatttggaaatatcatccataataatggtgtcacactcaatgtggctgatagacttggctgagtttttcgcaaaagtgacttgaccacggtagttgacttctccaccaccacgggcaatggatttggacacgatagaagatgaggtgcgtggggcgttgtgaatcatcttagcaccggtatcctgtacctgacccttgttggcaaaggcaatggacaacatggttccacgtgccccttcaccttctaggtaaaccgctgggtatttcatggtcgtcttggcaccgaggttgccgtcaatccactcaactgtggcatttttctcggcacgggcacgcttggttaccaagttatagacattgtctgaccagttctgaatggtggtataacgcatataggcaccttcgtgggcgatgatttccacaatcgctgcatgaagacttgccgttgagtaggtcggtgccgtacagccttctacgtagtgaacacttgccccttcatctacgatgatgagggtgcgttcaaactgacctgttccttcattgttgatacggaagtaggtttggagtggaatatccagcttgacaccttttggtacatagatgaaggttccacctgaccaaaccgctgagttgagggcagctagtttattatctgacggcggaacaagttttccaaagtattttttgaagagttctggatgttccttgagagccgtgtcggtatccgtaaagataatgccatgcttgtcgtactcttccttcatgttgtggtagaccacttctgattcatactgggcagaagcacctgctaggtaggcacgctcggcctctggaataccgatgcgttcaaaggtttccttgattttgtctggtacatcatcccagctgcgtgctggcttatctgacggtttttggtaatagacaatgtcatcaaaatccagctcagacaagtcggctccccaagtctgcatcggcattttcttgaaggtttcgtaggatttcaaacggaattccaacatccattcaggctcgcctttgatacgggacatttcacgaatgacttcttcgttcaaacccttacctgtcgaagccaccagttccacgttctcgtcatggaaaccgaatttgtattctccaagatcaatcggggttggttcaattctttcttctgacataatataagatactaagccccttaagaaagcaaatgaaaaacaggaaatcgacttcgtgtgcaaacacacgcggagatttatcttttttcaaaagcttttagggcgagttcaatttcatttccaatcagaaactgaacaatcctttctgtatgattttcatttttgtttattcgatgatgctcagtaagcatcttcacttcgttcgattgctttcttcaagacactaaacttggttggaactaaagttcctaaccaagtaacgcaaggttctaatcaaccttgctaagtggcttactaattggctgattttggtaatatcgaccaaaatcgctcatgtcgcagttacccttcattcagcactggaacgaagtgacagtgctttcttcagggcattccacggtaatgtggcacatttgatgcgttgggggaatttggcaacacctgcgaggagggaggcgtctcccagttccttctggcgtgggtcttcttgacctcggaccatttgtgagaagatttctgctagttcttgaatctgactgatttctttgccaagcactgcttcagtcatcatagaagctgatgcggttgaaatggtgcagccaacgccgtcaaaagcaatatcggtaatcacatctttttcaatcttgacggacaattcaatcacatcgccacaggttgggttgtggagttctaacttttccactccgtccaagcttccgcgatgacgaggcgacttggagtgttcagacacaactgccatataaagagagtctaatctagatagggccattgaaaaactcctttgtcttgatgattgcctcgaccaacttatcacagtcagccttggtattgtaaatgtaaaaacttgctcgtacagtagcaggcacctgcaaatatctgagaagcggttgggcacaatggtggcctgcccgcacagcaacaccttcatagtccagagcagttgccacatcgtgtggatgcaagtcgtccaagttaaaggcaataactcccgtccgcttggacaggtcctgactgccataaatggtcaagcctggaatagcctgcaattttggaaagacatagtcaaccagttctgcctcgtgggcctggatagcgtccataccaatttcggtcaggtaatcaatggccgctcccagaccaatcgcacctgcaatattgggcgttcctgcctcaaacttccaaggcaattccttccaagtagctgactgctcatagacaaagtcaatcatttcaccgccgaattcaactggcgacatgagattgagcaattcttccttgccgtagagaatgccaattcctgtcggtcccaacattttatgacctgaaaaggcatagaaatccacgtctaattcttgcacgttgacgcccatgtggggaactgactgggctccgtccaccaccaagtaggcaccgacttgatgcaccagctctgctatttccccaataggaaccacgccacctaggacattggatacgtgggccagggagacgaacttggtcttagaagatagtagcgaccgcagatggtccatgtctagctcgccgtcttttagggtcacatagcggagcttagcacccgtttgctgacaggcttgctgccaagggatgatattggagtggtgctcttggaccgagatgatcacttcctggtctggctggagaatttcctttgcaaactgagccacccagttaagactagtggtcgttcctctggtaaagagaatttccttgctagacttggcctgaataaaatctgccaccttctgcctagccgcctcgtagcgagtagttgcccgttccgaaagggtgtgaacgccacggtggacattggcattgtccttctggtaataatccgccagcacatctagtacctgctgcggtttttgagtggtcgccgcattgtccaaatagaccagcggctcatcgttaacaacttggtctaggattgaaaattccttgcgaatgcgttccaaatccatatcttatctctttgttagtttttcttcaatcacggcaatcagttggtcacgaacttccttaacaggaatttctgtgataacagagcctaggaaaccacgaacaaccaagcgttcagctgttgctcggtccagaccacgactcatgaggtagtacatgtcttctggatccacctgaccgattgaggctgcgtgtccagctgtgacctcattctcatcgataaggagaattgggttagcatctgagcgagccttatcagacaacatgaggacacggctttcctgctgggcatccgctcctttagcaccgcggacaatgtgtccgatgccattgaaggtcaaggttccactttctaagataaccccatgttgcaggatgtgaccgaccgaattatgaccgtagttggtcacgcgcgtatccacaccttggacctgacgacctgatgacagtccgacaactttgaggttggcatggctaccgtttccttttaattcgctgtccaaatcggcaaccacatttccttcgttgagcagaccaatcgcccagtcaatcgttgcatcgtttccgagatagccgcgacggttgaggtaggtatccaaatgcttgccaaggcggtcaatggccgcaaacttgatttggctaccagcaagggcgattacttccacgacaatattggctgaagtcgttgctgcgccgtcgcccaaactttcaaagcgttctagataattaagcttggcattttttccagcgatgatgaggacacgtttattaaaagcaactggactagtgctgtcttggtagaaaagggcctcaactggctggtcgatttcaacattatctggcacgtagaggacagctgttgcgttaaaataggctgtgttataggcggctaatttgtgttcatcgtaggctacggcagcgccgagatacttttcaagtacatctggaatgacatccatagccgatgcgaagtcagtaaagactacacctttctctacaagggcaaccggcaactgttctagaatcgtttggctgccaacttgaaccaacataggattgtcaccgatagctgtaaaatctggaactgccccgatttcatcatttgtagctaggcttccgtcacctagattccaacggtgaaacttgacccgctcgataaccggcaagtccagctctgctattttgtcaaaagccttaagacgcaggtctgtcaaccaagttggttctgcctgcaaggctgaaaattcttgaatcttttctttggtcatagcttcctccaaagacttaaatgtcatcttctttgtagtcgatgccaagctctgctgcgacttggacataaccttctttttccaagcgttgtgccaattctggtccgcctgacagaacaacacgaccttccatcatgacatggacaacatcaggagtgatgtagttgagcaagcgttggtagtgagtaataatcatggcaccaaagccttcaccacgcatagcatttatcccctttgacacgactttaagggcatcgatgtccaaacctgagtcaatctcatcaagaagggcaaaagttggttccaacatgagtaattgcagaatctcattgcgttttttctcaccacctgagaaaccttcgttgaggtagcgctctgccatttcctctttcatgttaaggagctccatcttttcatccaacttagtaatgaaatcacgaacagaaatcttgtcttcgtcttccttaccagcgttcattgcggcacgaagaaattccgcattagtaatccctggaatttctgacgggtattgcatagccaagaaaagacccatacgggcacgttcatcgacttctaattctaaaatattgacaccgtcaaacagaatctcaccttgggtaacttcataacttggattccccatgatggctgctgaaagggtggatttccctgttccgttcggtcccatgatggctgcaatttcacctgttttaagggtcaaattcacacccttcaagatttctttgccttcaatttccacatgaaggtctttgatttctaatactgacatgctgtgctccttttcatttttgtcctcttcaaaaaccacattaactgaccaagctaactagatacaccgataagactcaactttggcagtggggaaagagctcgaccattcatagaagagtccgtcaacaagtcctagttttaagttgttgagctgggagtgggaaagaactcgaccatccatagaagagttcgttttcccacccccgcacagttgattaggtcagatttggagtgtaaaacacgaacaaatctgccaatcaaccactactgcgctaagatgttgacactaacgttgagaagcggtacagggcttgagcccagcttcactccactggactgttaaacccaatcaaccactactgcgctgagatgttgacgctaactttgagaagtgatgcggggcttgagcccagcctcttttcttgttaatgatgattttcagagagtgttaatctataaaatagtcttttctgacaattttaattaaccatatccactatattatatcaaaaaaagagcctgacggctcttatcttgtttagaaagattcttattttctttttttctcttcacagcactttttatactttgcgattttttcttgacggtaactactattaccaataaaccgaagaagattgagcaatggagttctattaataccaaagatgccaatcaattcacagagaatctcaatccccagtcccatggtcaccaataggagaatcccccctattctactcgaaacattgagcaaaagagaggtcagggagaataagaaagagatggcgtaaatcaccaagactgtgccacgatgagtaagtcccagagagagcaagcgatgatgcagatgcatcttatctgcttcatagattttttgcccagacaattttcgacgaatgatggctactacagtatccgtaataggcactccaagaataatcatcggagtaaccactgcaacagctgtcgaatttttcagtccttgaagggacaagactccaatcataaacccgatgaagagggcacctgtatcgccaagataaatgatagcaggattatagttatacggtaaaaaacctacaatcgccgcaaccaaaacaaagatggttaaggtcaaaaaaatattgctatcatgcaaaaagaaataagacacaattcccatcgttgtcagggaaataatcgatactcccgaaaccagaccatccagaccatcaatcaagttgactgcattcgtaatggaaacaatccaaaggaccgttaatagaaaagagagccagacaggaaattgaaggaaaggtcctccaaaaggaatcttaaagctatcaaaacgaaattccgtaaaaatccaaataatcgtcgctgcagctagaataccaaacattttaggagcaggctttaactccttgacatcatcaatgaatcccgtaagaacgataatgctggatgctaggaccaggggccagatataatgcaagtaagtgccatggtaattgacacgggtaacaattcctggtaaaaaccataggacagaaatggtaaatgccacaaagatagccagacctcccgctgaaggcatgggcaccttatttattcgccgtgcattgggattatcaactgctccaaccctcagggacataaaacgaaccaagggggtcgcaatggctgatatgaccatggttgtaataatgaccattatgtattttagagcaaaaggaatcatactgtcggaaccttcctaagctcctcaattgccgcaagcggaagcatcaaagttccgtgttcttgtaaagcaggtctggtcaacttagtatcattggtaaattccaacattcttgagagaatgtagcctggatactgcttggaacgattttctacattgataagaactgtcaagtagtagtgaccatccattttatataattccgattcttctactggataatcaaccgtaccaacaaaagtaaacagatcctctatcgttggaaattccaaaatatagtaaatatagcgctcctgctcctcttcatctgcttcttcctcttgctctacctcttccaaatgacgaacagctgttgcatccggtgcacttttctcacgaacggtttgctccaaactcttgaaaaactcatctggagtcatacttgcgacatcaccaagttccgacaaatctgtaaattcatcaaaattcaagttctgatccaaatcagatttggtaacaaagatgtccacccgatctggcttcggagtcacacgaaaactcagcataccgctttctcggaaagtcattggtaaatccaattcatccaaaacagtgtaaaagaactcctctgtcttttcttgcggaatgagaaagtccgaaagttccattcctctctcttccaaatcatctaattttatagtgattttcaaggttgaatcactaatttgctttactttcataactacctcattcattgattcatcaattttttaaaattgattgatcattttcaatactcatacatatcttccaccattatactaaaaccaagctcgaaagacaaaagaaaagcaggtctccctgctcttaaaataaaaatgtgataaaggcataaaccaataaaatcgcccctaaaatgatgcggtagtaaccaaagaccgtgaaatcatgttttttaacaaagtctgtcaagaaacgaataacaactaaggataccaagtaagccgtcacactagcgactagcaagatccatacctgctccatattcaggctattgccatctaagaaatatttaacagccttcaaaccactataaccaaacatggttggaatcccaaggaagaaggtaaaatctgccgccacagatcggctggtccccaaaataatcgctcccagaatggtcgcacctgagcgactagtccccggaacgatgcttaagacctggaaacacccaatcaacaaggcagttttataagacattttcgctaagtccgtcacctgtggctctatacctctgttacggttctcaatccaaataaaggcaataccgtagacaatcaaagcaatcgcaatcggtaccataaaattgaaatgtgcttcaaaccaattatccaacgggactgcaattaggatggacggaatacaggcaatgacaaccttggcccacaattgccaagtcaattgaatatcacgcttggtttttccaggctgaaatggattcaattttttaaagtaaatagtcataactgctagaattgctcctagctgaatgacaatattaaacatttctaggaagttcttactttggtttaatttcacgaactcttgaaccaaaatcaaatgccccgttgaagaaactggcaaccattccgttaccccttcaatgattcctaaaaatatagccttcaacaattccaatagcataaaaagctccttttcatcaattctctacattatatcataaaaaaactccctattcatagtacaaggatattgaaatttgtcagaatttttaataaaatggtgtaatagcattttaaaggagacactatgaaacgtaaactcagtatatttctgctgaccctaatcgctgttttttctgtaacaacaggggttcgggcagacgaatacctgcgggtcggtatggaagctgcctatgcaccatttaactggacccaagaagatgatagcaacagtgccgttcctattgagggaaccaatcaatttgccaacggatatgatgttcaggttgcaaaaaaaatcgctgcatccatggataaagaactcttggttgttaaaaccaagtgggaaggcttggtccctgctcttacatctggtaaaatcgatatgattatcgccggtatgagcccgacagaagagcgcaagaaagaaatcgccttctcagatagctactacacttcaattcctaccctggttgttcgttctgatagtcagtacgcaaacgcaaccagcttggaagattttgctggcgcaaaaatcactgcccagcaaggggtttacctctatgatttgattgaccaaattgaaggggctaacaaacagactgccatgggagatttctcacaaatccgtcaagctttagaatctggcattatagacgcctatgtttctgaacgtccagaaggtcgtacagcagaagctgcaaataaagctttcaaaatggttgaattggcagacagttttgaaaccaatgccgaagacgtgaccattgctgtcggtatgcgcaaagatgacgagcgtatcgctcaggtcaacgaagtcttagcaactatttcagaagaagagcaaatcgcacttatggatgatatgattgaaaaccagcccgttgaagaagccagcgagggcgaaacacctagtttcttcgcccaagtttggaatattgttgttaacaactggcaacaacttctgcgtggaactgggatgacattactcatttccatcctcggtacaattatcggtactgctatcggtctcctcatcggtgtcttccgtacagctccaaaagcagcaaacaaggcgcttgctattggtcaaaaagtgctcggttggattatcaatatctacatcgaaattttccgtggtacgccgatgattgtacaatccatggttatttactatggtaccgcccaagcattcggactcaatcttgaccgcacacttgccgctatcttcattgtatccatcaacacaggtgcctacatgagtgagattgtccgcggtggtatctttgccgtcgataagggccaatttgaagctgctactgctctcggatttacccataatcagaccatgcgtaagattgtccttccacaggttattcgtaacatcttaccagcgactggtaatgaatttgtcatcaatatcaaagatacttctgtattgaacgttatctcagttgttgagctctatttctcaggaaatactgtcgcaacccaaacctatcaatatttccaaacctttacggttattgctattatctacttcatcctaacctttactgtgacacgtatcttacgcgcagttgaaaagtattttgatacagatacatacacaacaggtgcaaaccaaatgcaagtcgaggtgccacatgactaaaaatgtaattcttgaaatcaaaaatctaaagaaatcatacggacaaaatcaagtcctcaaagacatctctattagcgttgaaaagggcgaggttatctcaatcatcggttcatctggttcggggaaatcaaccttcctccgatctatcaaccttttggaaacaccaacagaaggacagattctataccacggacaagatgttttggctaaaggatatgatttgacgacttaccgtgaaaaactaggtatggtattccaatccttcaaccttttcaacaatctaaatgtattggaaaatgccattgtagcacaaactacggtactgaaacgagatcgagctgaggcagagaaaatcgccaaagaaaatctcaacaaggttggcatgaccgaacagtactggcaagccaaaccaagtcaactctctggtggacagaaacaacgcgtggccattgcacgtgccctatctgttgacccagaagttatcctctttgatgagccgacttctgctctcgatccagagatggtcggggaagttctcaaaaccatgcaagatttggcaaaatcaggattgacgatgcttatcgtaactcacgaaatggaatttgcccgtgacgtatctgaccgcgttatctttatggataagggtgtcatcgccgaagaaggcagccctcaacaaatctttgaaaatccacaggaagaacgcacacgtgaattccttcagcgttttcttggataaactcaatctattccatagaagactattacttaccagtttcaaagctggtaagtttttttagactaaaaaaaagaggaattcgtaaaattcctctttttggacatctctaaatgaaaccatttagattagttttcaaatttcttgtggtttttgtcgtaaaaatcaatcaaacccaaggcagttgcaaatgaaatattgtcaatcttagcgcgaccttgtgcaagagcgataactgacatttcacgagcatttgtttccttactgatacggtaacctgtgattttcttttcacgaacccagccgacaacagcggctactttttcgtaactagtcattagaaacccctttcttttttattcgtgcaatttagtataatatgttttaacctattttgtcaagtaaaatgttcgttttttaccatcattttgccctaagagatgatagtatttgcgtccttatgtcttcgaccccctccggattccccggaaggaagatagtttgattacctccttgtgcaaaattattgagagtatccaagtattggttggtcagcaagatagacataatctgctcttcagataggctaacatttgattctttcagttcacgaatcgaatctgccagtccgtctacaatcgccttacgttgttgtgcaatacctacaccatgcaagcgatccttttcagcttctgcttctgctgctgtgacaatttttatcttgtcagcttctgccaattcttgggccgcaacccgtttccgttgagctgcgttaatttcattcatagattgcttaacctcggcgtctggctctaccttggtaattaaggttttgacaataacataaccgtaggttgacatttcttctgctacttgtttttgtacctcaagtgcaatctcatcctttttctcgaagagctcatccagtgtcaatttaggcacagatgaacgcagggcatcttcaatataggacttaatctgtgcttctgggtgcatgagcttgtaataggcatccgtcacattattttcatttactcgatattgagttgccacattcattgtgacaaaaacgttatcctgcgtcttggtttctaccacaatttcactttgcaacatccgtaattgaatgcgggctgcgatgacatcgactccaaatggtattttaaagttaatacctgaagtagatgttttttggtatttcccaaagcgctcaataatagcgaccgtctgctgcttgacaacgtatagccctgaagcaatcaaaatcaaagcaatcagtacaaagaacaagaaactaccaataaaaacaattggaccaaacaccataatgacctcctaaactagcattttataaagcgaatcattttcatgaagattgatgtactggggatcaaactcttccaagcgagaaataaactgcgtataatctgttttatctcctagggcaataccgattagaaccggtcctgttcccttattggcacgtttgatatattcaaaacgagtaatatcatcatttggccctagaatatcatttacaaattcacgaagagcccctggacgttgtggaaaattaacaacaaagtagtgtttaattccctcgtagataagcgcacgttcctccatttccggcatcctgttgatgtcgttattaccaccagaaatgatacaacaaatggtttgccccttgatttggtccttgactacctcaagagctgcaatcgttgctgctcctgctggctcagcaacaatacccagcttagaatagaggtctaaaatagtcccggaaatccacccttcatccacaccaatcaggcgatctacgtatttccgagccacttcgtaggtcgacttaccgactttctgtaccgcaataccgtcagcaaatttatcaatttggtctaatttaaccggacgacctttatcaaaagccgctttcattgaccgtgccccacttgcttcaacaccaacaatcttaatttcaggtgcatgttctttcagataggccgaaacgcctgcaaccagaccacctcctcctatgggaactaaaatttggtcaaaactaatggtttgctcttccgcttcttccaagatttcataggctactgttccctgaccagcctgcacattttcatcatcgaatgggtctataaatgttttcccactttcctgagtataatcttgtgctgccttggctgactcatcgaaggtatcacctacgagccgaatctctacataatctcctccgaaaaatttaacctgccctattttttgttgcggagttgtaatgggcataaaaatcgtagcaggaatttgcatttcctgacaggtgtaggccacaccttgagcatggtttccggccgaagcacagaccactccgcgtgacttctcatcatctgtcaattgtgaaatagcataataggctcctcgaattttaaaagagcgaacacgctgttcattttctctttttaaataaatagttgcaccatatttttccgacaagtatcgactataatccaagggggtacgtactaccacgcgcttaagaacggagtatgcttgttctacattttttgctgtaatcatagttccattaatttctttctatatttattgtatcaatattccctagaaattcctagtatttaaactattattatgtcattttataaaaaccgaacttttttatttttttaatgtattcatgaatgaaatgggcaaaagagccggaaaaaaccagctcttttattcattttcagagatagggaaaaaagggaatgacatcccctcatccgccaactcaaaccttaaatgtattgccatcactcaaagtaaagctgactatcctcctatccaccatgatagtgtttaattatagattttgaatgcgtcgtcatcattgcgtccgacaaatggcattgctttgcggagctctgcacctactttttcgatttcaagattctctgcttctttacgataagcttccatacgtggacggcctgctttatagtcatttacaaagtcatttgcaaatttaccagattgaatatctgcaaggactgccttcatgttttctttgacttggtctgtaatcacacgtggacctgatacatagtcaccaaattcagcagtgtttgagatagattggcgcattttcttaaagccaccttcgtagacaaggtcaacgatgagtttcatctcgtggagaacttcgaaataagccaattctggtgcataacctgcttctgtcaagacttcaaaacctgcctgcataagggctgtcaaaccaccgcagagaacagcttgctcaccaaacaaatcttcttctgtctcttctttgaaagttgtttccaaaagaccaacacgggctgaaccaacaccttttgcccagtccatcgcaatatgttttgcattgccagttgcatcttggtaaacagcatagagggctggtactccaaaaccttcttcaaaggtacggcggaccaagtgacctggaccttttggtgcacacatgaagacatccacatctgctggtaccttgataaattcaaaatgaacgttgaaaccatgggcaaaaccaagggcattgcccgcttccaagtttggagcgatttcttcattgtaaaggtctgcttggatttcgtctggagccaagatcatgataacatctgcttgttttgctgcttctgctacttcaaaagtttcaaaaccatcttcttttgccttgtcaaatgacttacctgcacgcacaccgatgatgacatcgtgtcctgtatcacgcaagttttgagcatgggcatgaccttgtgaaccataaccgataacggcgatacgtttaccgtcaagtgctgctactgttacatctttttcatattgcattgttactgtcataattttttctcttttctatttttatttgtagttttggatgttcaaagaaaatgaaggctagactaggcgatgtaggcgaagatagaactaacgtccatcaagccaaatcaacgcaggataggtcttattatcgaaaaggattagtctctactaaagccagtcgcacccgttcttgcgatattcttgatgccataaggctgaatcacacgcaggagggcgtcaatcttatctccatcacctgtcatttgaatggtaatggagtgaggtgctacatcgacaacatttgctctaaagggttggataatcgctaaaatttctgctcgttttgttggcggagctgagattttaacaagaatcacctcacgctctaagtggggaatgtccgtcaaatcacggacacggaccacatcaatcaagcggtttagctgtttgatgatttgttcgacctcatcgtgactgaccacgtctacaatcaccgtcacacgtgagatgccatctacttctgttgggccgacggagatggactcaatattgatttggcgacgagataggacacctgtaaaacgattcagaacaccagatgaatttcgcaatttagctgttaacattctacgcattgaacttcacccccaacatttctgcattgctcttacctgctggcaccatcggttgaacatgttcacgattagaaatatgaacctctatgagcattggtttatcttctaagataactttcatatcttcacttagagtcgctggattgtcaaaactataatgactaattccgtaggcctctgccaacaattggaaattcggttcatcgtcaaagacagattggctacgacgcttttcatagaaggattcctgccattgacgaaccattccaagagagtggttattgatcaacacaaccttaatcggtacaccatagccattcaaaatagccaattcttggttggtcatttggaagccgccatcaccaacaaagatgattacttctttatctggattggctaatttggcgccgatagctgcaggaataccaaagcccatggttcccatgccaccagatgttacaagttggcgtgcatgtctgtaggggtagaattgagcggcccacatttgatgctgaccaacgtctgttacgacaatggcatccccttgcgtcaactgaccaattaattcaattgccgcctgtggcttaataaccttttcatcttcatcataccaaaatggtgcccgacgtttgttttccaatacttgtgccgtccaatcagcatagcctgtttcgactgtttctaaagcaagcagagctttcaaggttgccttagcgtcgcccactaccggaatagccgttttgacaactttaccaatttctgcgggatcaatatcaatatgtgctaccgtcgcatttggcgcataggttgttggatttcctgttaggcggtcatcgaatcgcgctccaatattgataatgtaatcagcctgatccatagccatattggcagcgtatgaaccgtgcataccacccatagccaaggataattcatgctcaatgggcattgcacctaatccaaggagggttgaaactactggaatacggtagcgctctgcaaaggcaactaattctttattggcatctgcataattgacaccaccaccagccaatataactggtttttgagcttggctaagctgtttcaaaattttcttaacctgcaaaccatttggttcaatcgttggctgataacttggtaggtgtagagttgggtcatgataaaaatcaacaactctttcttggatatcttttggaacatcaataacaacgggacctggtctccctgttgtcgcaatatggagtgcttctgtgatgactctaggaatatctgccgtatcccgaatttggtaattgtacttggtaatcggcattgtcatccccaagacatctgcttcctgaaaagcatctttaccgataccacgtgttgcgacttgaccagtaaaaactaaaagaggaacactatcacccattgcgtccgcaatcccagtaatggcattggtagcacctggtccagaggttacaatggctacgcccacctttcctgatgatttagcgtatccttcggcctcgtggaccgctccttgttcatgacgagccaaaatatgctggattccctcatattgatagatagcatcatatagaggcaaaactgccccaccaggataaccaaaaacaaggtctactcctagctgatgcagagtgtccaaaatgagataggaccccgaacgtggttggtctagttgaatttcttgcacgaatattcctcctctctgcaaatttgttatctactataatatcacaaggaagtagaatgtcaagaaattttctgaaaattcctacatttgttcgttttcttaactatttcctaacatttcttaagcaaaacttaagcaaatcccttgactggcttggtttcagcttgctttcagaaaacatcagtatagtagttccactaaaaaaattaaatgaggtttaggatatgtattatgtagtgataccggcttaccagccagatgaaaaattaatccaactattaaaaataatgaaaaacaggctaaattgtcaggtcatcgttgtggatgatggtagtactggcgcatccaaaaatattcttgaaatcgccaaaacctatgccattgttctccaccatgatgtcaataaaggaaaaggccaagccttacgaacagcctttagtttcatccaagatttgagaaagcctggtgtcgctgttaccgctgattcagatggtcaacacgctgtgaatgatatagaccgtgtcgcacgcgcagccatgaatctaccaagccgcctcatccttggtgttcgtcaatttactaaagacatcccgctccgtagccgatttggtaacaaactaaccagagtattgtttagattgcaaactggtgtcaatgtgtccgatacccaaacaggcttgcgtggattccatactgacttaattccattcatgttagatattgaaggcgaccactacgagtacaagatgaacatgttaactcaggcaagtcaacgctataaaattacggaagttccaattcaaactatttatatcgatgataatgccagttcgcattttcgtcccataaaagatggactgctcatttacaagaatctcttcaaatttgccctggcatcttttggtggatttctagttgactacggaatatatgcacttgccttattgctactcactagcttaccaactgctctacgcttattggtcgcaaacacgattgctcgcatttgtagcgctacctgtaattttgcacttaataagaaattagtctttaacaatgaagagagcatcgcacgaacaggcgtaggctactttacactagcccttgtcctcttcctttgcgatacagccctcctatatctcttccaccaaattctaggactcaacctctacattgtcaaacttgcagttggtatcttccttttcctagcctcttggttcattcagaaaaatatcatctttaaagaaaggaaatcattttcccatgaaattgcttaaaaaaccctttgcctacgcatccatcttcggaatgcttttgacaggaggttttacttactccatgttaaaaaccttcgtgctttccgaggctatcacaacggttgctgcaagtaatgctacttctacgagcgagcagaatacaactacagcttcgtcttccactactgccacaacagcaacgaatgtctctacaacggatactagttacactgatgacaatatccaaatcaacttagagaccatcactaccaacaacacaactgtttacgtcgcagatattcaagtcagctctccagagtatttaaagacagctctagcccaaaatacctatggcacgaacgtaacagctaaaacttctgaaactgcggcagcaaacaatgccattctagcggttaatggtgactactatggagccaattcaactggttatgttattaagaatggggttctgtatcgagacaccgttcgggacaatgcagcttatggcgacttggccatctacgcagacggctcatttgaggtcatttatgaaaatgagattaccgcccaagaattgattgacaagggcgttgtcaacctcttagcatttggtccatcattggtcgaaaacggcgaaattgtcgttgatacatcaacagaagtcggacgtgcaatgtcatccaaccctcgttctgctatcgggattatcgatgaaaatcattatatcatcgtcgtagcagacggacgtacgtctgaaagccaaggactctctctatatcaattggccgaagttatgaaacaatatggtgctcaaactgcctacaaccttgatggcggtggttcatccactctttattttaacggtcaagttattaacaacccaacaacaaatggaaatactatctcagaaagggcggtgagtgacattgtctacatcggttactaattcaactacaagagtttcaagaacgtttatctcctacttagcaataacagctttcctgtttattttcagtcgaatctatgaaagtctcagctatggcgaagtctctgtctttatgcattatatgttctgtgtaccattaataggcggagctgtgctactcggtttgctgcaacttatacctactctttcacgtctctcttataatttgtggaattctggcgttgcaactattacagctggttgtcttctccgaggcattatcaacctatctggacgttcaactaccttagatcaaccttattggtacatcggcgcagccttcctagttctatcgttagtcggtcttttcatcaatccatccgcaaataatcatcgaaaaacgacctcttaatctacaaataaattataagggcacttaacattcttaggtgccttttactgtagaataaattgttgaaaaattcggaaatttccaattgtttatcaaatcttttatcgtttctttcatatctatgatataatgggtaaaataagatagggagaagaaaattatgaccgatacaaacaaacttaaagactttcgacatcgtagctctgtttacgattcgatggtcaaatcgcccaaccgtgctatgttgcgtgccacaggtatgaccgatgatagctttgaaaagcctattgttggggttatttcgacatgggctgaaaacacaccctgtaacatccaccttcatgactttggaaaattagccaaagaaggtgtcaaggaagcaggtgcctggcctgtccaatacggtaccatcaccgttgcagacggaatcgctatgggaactcctggcatgcgtttctccttgacttcacgtgatatcattgcagattctattgaggcagccatgggagggcacaacgtggatgcctttgtcgcaatcggtggctgtgataaaaacatgcctggttccatgattgccatcgccaatatggacattcctgccgtatttgcctacggtggaaccatcgcaccaggaaacctcaatggcaaagatattgacttggtttctgtcttcgaaggaatcggaaaatggaacaacggtgacttgactgctgaagaggttcgtcaaatcgagtgtaatgcttgccctggacctggtggttgcggtggtatgtacactgccaataccatggctactgccattgaggtaatgggcatgtctattcctggctcttcttctcaccctgctgaatctcctgagaagaaggctgatattgaagaagctggtcgtgctgttgtacgcatgctagaacttggcatcaaaccatctgacattatgacgcgtgaagcctttgaagatgccattacagtcacaatggctctgggcggctcaaccaacgctactctgcacttgctggccattgcccatgctgccaacgttgatttgaccttggaagatttcaacgatttccaagagcgtgtgcctcatttggccgacttaaaaccatctggtaaatatgttttccaagacctctataatgtcggcggtgtccctgcggttatgaaatacttgctcaaaaacggcttccttcatggcgaccgcatcacatgtacaggtaaaaccgttgctgaaaacctaaagaattttgcagacttgactccaggtcaagatgtcatcatgccacttgaaaatccaaaacgagcggatggacctctgattatcttgaaaggtaaccttgctcctgaaggtgccgttgccaaggtttctggtgtgaaagtccgcaaccatacaggtccagccaaggtctttgattctgaagaagaagctatcgaagcagtcttgactgacgaaatcgtagatggcgatgtagtcgttgtccgctatgttggaccaaaaggcggtcctggtatgcctgaaatgctgtccctttcttctatgattgtcggaaaaggccaaggtgacaaggtagcccttctaacagacggtcgtttctctggtggtacctatggactggttgtgggacacatcgcacctgaagctcaggatggtgggccaattgcctacctccgtactggtgatttggtgacggttgatcaagataccaaagaaatcaccatgcacgtttctgaccaagaaatcgaagaacgcaagaaaacaactgttattccaccactctactctcgtggcgttctcggaaaatacgcccacactgtatcctctgcctctaaaggagccgttaccgacttctggagaccagaacgtacggggaaaaaataaggaactcaacgaccctgtcctcgcggtagggttttccaaaaggagaaaaaatgaaactaaacgtcgaactctcccgctttcgtgttaaagaaggcaaaaccgttcaagtagatgaatggatggcctttctcaacgagcacatggaagacacccttctcactcttgaaggagagaaaatgtatgtcgaaaccatcttccgtgaggtattggacggacgcgaatacctctattggtactctgtccaagccgaaggggggattgaagtcgaagattcagaatcctacatcgacaaaaaacatttagaatactgggaagaatgcattgatccaagctatggtatggtcgatctggatcctcaagtccttatgattcccaaacccatttatgaaacgatggaagaattagacagacaatacgatgacacgtttaaaaaagagctgcagtaaaataaaactgcaactcttttatttagggcttatccccagagtaattcgacctaagcgactaattcttgtcattttccaagcaggagaccaaacaatctcgacctgagcatcttctattccgtcaatagtcttcaaagctgctactaactctccaggcatcgtatctgcacatgagcaacctgcatcagtaaaggtcataactactttacaaaacccggtttcatctagatgaatttcatagacaagtcctaaattgtatatatccaactcaatctcggggtcgtgaatggattccaatacctccaccaattgatctgacaaaataagggctcgctcattgatctgaatatcttctctcatttatccaaacactcctaaaacatttataaaaagtattgtatcataattatttgaaatatacttgtcttaccaaatgttttcaactagttttcaaagtgcacgaacctctgaattctcaccttgaccaatagaaaagatatacttatgaccttgagtcaagctatgatagaagccatgaccagcataaatctgaaatacttgcattgtatcactagactcatctttatagatatgttgataataaggattatccgcaaaaactgtctttagatagtcgttctccacaggtctagcagccccttctacacacacgcactacctggataaggtacccttcctcagaaatagccgtcatcgcaactctttgatcccccatcaattgatcataaaaatgcgtttctgggcttgtcataaagaaaatcccttcttcgtttgctgcagtgatatgagcatgacgagcatgtggatttccatactcatccaaagtagcaaaaaccccaaccttcatatcttccaaaatatgcataatatcttttagttccatggtatcaccccttgaaaacacctattttctaaagtatatcaaaaacaagcgaaaatgttaagtggaatattgatagaaatagtgaaagtgtttcatgaacaactccctactgacggaaccatttaagaaggtagctatgtttgcttcattttcaaccttcaaaggttcctgaacccttttgatttccaattggtatggatttgactctgaaccgattatgacatcaatcaaaatccgttgtaactataaaaactacctaattataaaaaagcgactcttgagtgctttgaaacgttgatatattgcggtatattaacgtttactaaactggcttgctttacgtgctttcttaagacctggtttcttacgttcaaccatacgagcgtcacgtgtaagaagacctgcgcgtttcaatgaatcgcggaagtctgggtctacttgaagcaatgcacgcgcgataccgtgacggatcgcacctgattgaccaccgtaaccaccaccgttcacgttaacgaaaacgtcgtatgaaccttgtgttgaagttactgcgaatggttggttgataaccaaacgaaggtcagcatgtgggatgtactcttctacatcttttttgtttactgtgattttaccagtacctgggaccaaacgtacgcgtgcaaccgcgtttttacgacgaccagtacctgtgtattgtgcttgtgccatttagattacgtcctttcccttagataagacctgaaatatcaagtacttctggttgttgtgcagcgtgagtgtgctcagcacctacaaacactttcaacttcatgccttgtgcacgaccaagtgtgttgtgtggaagcatacctttaactgatttctcaatcaaacgaacagcgtttttagaacgcaattcaccagctgagattgatttcaagccacctgggtggtttgagtgagtgtagtagatcttatcagttgcttttttaccagtcaatttcactttctcagcgttgattacgataacgaagtcaccagtatcagtgtgaggtgtgaaagttggtttgtttttaccacgaagaacgctagcaactactgctgaaaggcgtccaagaggtacatcagtagcgtctactacataccatttacgttcaacttggcctggtttagccataaatgttgttttgttcatgatttctcctatacgaatcgtttttgtttactgggcggatgttccggtccgcgggtatttggaaggttccggggcctttcaaatggggtaaacaataccatctaccattttatcaaatctactagtgtccgtcaagctattttactttactttttttattttttgaaagatagcagagctgctgagaatgaaagccttatccattttaaatttcttactgccctagttgtccaggcaagaccagcttctccttataaggaaaggttttatcaaattcttccaagaccaattcatccaccgtatagaccagaggacctgtaaaacaccagtttcagccatccaaggcttctggttggaacaacttgacaatgagcattatcgtacctccttttgattaccctattctacataagtcgtcatcacacaaaaagggacacatctttacaagaaatatcccttagaatctaggctctcattgctgtaccaattgataaaatagctaagactcctgtccctgtatgagtggcaatcacaggccctaattctgtcaatagaacatcagaaatacggtcgtcttccaataaactagatttgacgccctctgccgcctcaatatcacctgtataggccaccatgaccgtagaatgatccaagttgtccaaggtcaagttcagcatttccttaattccttttttacgaccacggattttggcaatggcttctaacttcccttccgcattgagtgcaaggagaggtttgatattgaccaatccaccaatgagggctgccgctttagacaagcgtccacctcgcaccaaatgattaaggtcatcgaccaagaggtaggttcgtaaacgcggcaccaaatcttctacgattgccttggtttctgccagagtcttacctgcagcacgtgcctcaacggctttcatgactaagtagccttctccaatggtcgctgcctttgtatcaacgatggtgatgactgcttctggatattggtccataaccatatctcgtgcaataactgcactctggtaggtccctgaaagagctgctgagaaagcgagataaagcacctcatgatcttccttggctgccgcttcaaaaacttcttcaaactgaccaacattgacctgactggtcgtgggttggctgccagaagccattttctccagtaaatctgcagaggtcaagcggttttcaccgactgtttcataggttgcgccgtctaggttaatggtcaaaccaagcacggtcacatcgttttcttggacccagctgattggcaaatccgatgtcgaatcggttacgattgtaaatgtcactctttcatttcctccatcatttcttttaaggcttgaaaattcccatctgaccagggattgagccgtggggtgtagagttctacctggtccacaaacttgtccaagtcctttttgatgaccttggttctctcctctaactcacgcgccgaaacccgtaaggccccttgtgaaaagaccacccattgttcgttgaggtcgctggttgcgacggaaacctgcttgcgacggtcactattgagctgggcactgagtcgttcgatataactatctgccgtctcttcctcctctgtaaaaatgaccgataccttgaattcgtcatactgctggcgaagacctggcacatggtgggcatcaaagacacaaatcacctcaatctgttcaaaggctgcgtagtgagacaaggtgcgaagcaaggtcgttctggccgcatccaagtctccctttttaaaatcttgcttggtggcctgccaaaaggcaatcatgttgtagccatctacaatgagaactttttctttcatttagattttcttccgaaatacttcgtacatcagcacagctgctgctacgctggcgttgagagattggacatggcccttcataggaatggtaatcatctcatccacctgctttttgatattgctggagatgcccttgccttcgttgccaataataagagctagtttgccagctgtattccacttgtggcttggagttccgttcatatccgtgccaaatacccagaaaccagcctccttgagcttatcgagagtttggctaagattggtcactcgggcgattgggacatgggccaccgcacctgttgaggtctttgccacaacgggcgtcacgccaactgctcggtgcttgggaatgatgatgccagctacctgagtggcatctgcggtccgcaaaatcgagccgaagttgtgggggtctgtcagaccgtccaagatgagaatgaggggattgtcttcctgctctgctttttccagaatcaccgacaggtccgcataggcgaactcagagacccgcaggacaaagccttggtgaacggcaccttctgtcatgtcagacagggtcttcttgggcgtccaagaaatcgacaccttcttctctgccgccagggccttgattttttcaacattttttccgcgcaaatcatcctggatgtagagcttgttgccggtgttagcctccaaactctccaccacagcatgtacgccatatacgatatcattctgttccatggttttattatagcatatttttgaaaaggaaaaagccgagaatttctcagctttcttagttcacactgttttccagataataatgttgggcaacataccagttgacacccccttgttccggatctgtatcatactcactagcttccaactccccacgactattgatccgataactccaatttcgtggctcaaaattagggtctgatggtacagttacatctgcataaactaaaccatcctcagccatacgaacacttatgacaacctggtcttttcgatacttttcaatcatgacgctacggctaaataaatcatccataacccaagcttttacctgatctgtcgttaagtttttggtatcaacctgcggtacaggattatgcaaatctgtcaacgaaatccaaccctgtcctgactttaatctgccccaactatgtccttccttttgagtcgtctcaactatcgtgtacgttccaggttctatattggtcacaacttctccagataaactaggttcctgacgaataaccagtccttgttttttaatatccacagtaaacaattgaacggcgctacctacctgagactggctagaagcttgcgaacttccagcagtcttactagtggctacctcactagttgaactatcctcaactacggtagtatcctttgcatctacatttttagcaataattaagttaaccgcacttccccgctttaccttcttcccactacttggagaagatacactaaccatcccaggctgaactgactgtccaccaacttctgttattgtaccaacttttaacccctcttcatacagtaaatccttagcttcagatagctcaataccatataattcaggaactgtaacttgagaaatatcttggtatacaaaatataagccagccattcctaacacagccacaacacttgaaatgattagccatatctttcgtctttttgcgtctgccaaacgtttctcagcttgctctctttgataattctcataatcttcctcagcttcgctaagcatttgctggatgacaaatcgttgactctcatccgtaacctgtgctaagtgcaatcgtaattgaaaaattctatccttaaactctttttcaatttgacgctcatgctctttttgcaaaatgttattttgtttttgaagtgctattgcttgagagttcatagcagaggtttgagcatccattttttgcttcaattcatcatgtctctgccgctcttcaaaatctcgcatccattgatccataataatcatctcctcataaaatattggttattatctacaaataaaatctattttattttagtatagcataacaccttaatttgtcaatcctcattttcaccccgtttcaatctaacttttgacaaatagtaaagcctatgatattctaacatctactatttgtccgtacaaacggaatcgaaaaaggagattttatgacacttatttttggaattgtggcggggctgattgcctttgctattggtggtttgtggtatggtttgattttccgcgatgcttggatcaaggcttcaggcattgacatggctaaggtagaagcagatcgtcaggctggcaaaaatggacagaaggaaatggtgatttcccttgtcattgaagtactgactgctgttgtggttattttcttcatcaagaccctcggtgtttcaccacttcatgcagctggtggcatgggcgtaattgcggtccttgcttcattgaaaaactacgtctttgagcaacgtcctatcaacctcatcctcatcaacgaaagctacaaactagtctgctacctagtagtcggtattctagctctatttgcataagtaattccctcctatccttaggaggtttttattttatgatacaatagaaatagactaaaaccaaaggagccctcatgtccctctccctccgcaccatcaaactgatatttgccaccgttctggctatttacctagcgaccgtactgggcctgtcttatacgacagcggcaggcatcatcgccattctcagcgtcctcgacacccgcaagtccagcttcaaaatggcccgcaaccgcctcttttccaccctcctggccctgaccatagcagtcctgaccttcgccctctttggctttggcatctggaccctgggcatctacctagcactctacgtccctctggcctaccgtttcaactgggaggctggcatcgccccatcgaccgtcctcgtcacccatctcttgctagagcaagatatttcgctgatttttttgggaaatgagctgacgctttttctgattggggcaggactggcactcttgttcaacctctatatgccctcgcaagaaaagaaaatccaggcctaccatgaccaagtcgaagacctactcaagcagattctcctccgctttgaagcctttctgctcaacggcgacggacgaaacgaggcagaattgattacgcagctggataagaccttggatgaggccctgaaggtcgtctacctagaccgccacaaccagctcttccagcagaccaactaccaggtccattactttgaaatgcgggcagcacaaaacaaaatcttgcgaaccatggcaggaaatatcaacaagtgtttactggaaggcagagaaaatgtcatcctgtccagcctcttcgagcgagcagcccagcaactgagccgagacaactccgccaaggaactgctcctagacatcgaactattccatgccaccttccgcgagcgacctctgccacaaacaagggaagaatttgaaacccgtgctaccctctttcaactcctgcatgatatggaagcttttattcgcctcaaggttgatttttatgaagtctataaagaccaagaaccgtcaatttaagccgacggttcttctacttttccatgaaattcatctgatacttggttgtgcaaatgcacgaaagataggcccatcatgactgcattccctgcaactgcaatcataaattcttccttggaagatacctttcctagccaaatggagaggattaaaatgagattgtaaagaaggatagaaagagctgccaaacgaatttttttcagtagtgtcttcataggaacctcctgtaagtgttgggagtgggacagaactcgaccatccatagaagagttcgttttcccacccccgcacagttgattaggtcagatttggagtgtaaaacacgaacaaatctgccaatcaaccactgcgctgagatgttgacacgaactctgagaagtggaactgggctttttgcccagcctctttaataaaaataacaagtatttatgcgttcttaaccccaaaaaaccgccagattttcatctagcggtcaggtgttttatgaacgattttagaaaggttagacaatcgccttgcttgtttcatcatcaaagaaatgagctttgttgaggttgaaggtcaagcgaactttgtctcctgggttgtggtagtcgcgtgcatcaacgcgagatacaaactctgtgctacctactttagagtagagcatggtttctgcaccgagaagctccgatacaaccacttctgcttctacgatggaagatggataagtgtccaattccaactgagaagccttgatgtcttctggacggataccgagggtaaatgatttgccattatagcctttttcttccaagtgtttgcgacgtccttctggaagctccaccttgaaaccatctccaacaagaacgccatcttgaagcgtaactgtgaagaagttcatagctgggctaccgatgaagctagcaacaaacttgttaacagggcggttgtagagctcttctgggctaccgatttgctcgatacgaccgattgtacctgtgcctgctgggtttttagttgcagacatgataacgatacggtctgccaaggtcatagcttctgtttggtcgtgggttacatagatggttgtcgcaccgatacggcggtggattttagcaatctctgtacgcatggatacacgcagttttgcatccaagtttgacaaaggttcatccatcaagaatacttttgcatcacgaacgatggcacgacccatggcaacacgttggcgttgtccacctgaaaggtcagctggtttacgttctaagaattctgtcaaaccaagaatttgagcagcttcttctacacgttttttgatttcatccttgctgtatttacgcaatttcaaaccaaaggccatgttgtcaaatacagtcatgtgtgggtagagggcatagttctggaataccatggcaatgtcgcggtcttttggagccacatcattcatgagaacgccgtcgatgtatgcttccccttctgtgatatcttccaaaccagcaatcatacgaagagttgttgatttaccacatcctgaaggacctacaaatacgataaactccttgtccttgatgtccaagttaaagtcttcaacagagtagtgctcgctgtttggatattttttatagatattttttaaattcaattgaaccatgttcaatcctcgctttctttgatagttttattgtaaatgaaaacgctttatttttctaggtcaaggtgaacaaaaagaacacaatcttttgtacaagttgcacaaaagactgtgttactgaaatagtttactttccaaaaattcaatgagccctttgggattttcagtagaaaagggacgaagcgatgggtggcattctcaaaggctacaacgcttttctcatcattagctcctattagatacttaaatccatgataaccatgtagcaaactgccaaatccgtcaattccttgagctgtaatcccgtccaatcaaaccatttgtccaagcgatactgtagcgtatttcgatggatatagagagactgggctgccttggttatgaccgcaccttcttgccaaagagctacaatttccttttctagctgctggtgggcaatcaaactagcaagtccttctctcaaaacggggtggagttgacctgcccaaagatagagctgaccgaaggtaagcaaccgtgattgatggtggctgcttcgccaatggtgaaaaagggattgttcagcttcgattaattgcggccaagagtgtaccaatttggctggccagatttgccctaaaaacaatgtaattctcagaccaaaatcgaactccatggtagcaagggtgtcacgcagtatttctttgacgtcaaaaagaggtgcctgatgtagaatgaacaggtaatcttgtccattgcctgtatagtagccttggagattggggaggagtttggccatcatatcaagccaggctacctttccatcttcatcggatacgtggcctacatgagcatgaataacctgtagtttttccaaggtttgtggaagaggacctcccccttggaaatagcgtccccaaggatgaccttgttctgcgctcgagtcattcatcagcaagtcaatcagttcgatttctcgatctgtcaaatccttgcgatcgacggaaaaccaggtttgattagccagaggcaactggatacttgctccgttttctgtcttttcaaatacaagccttccttttggaaataggtgctgcaattcttcccttttgctcatctcgcctccatctcattctgtctgtaattgaccgattttctgtcggtaatttttgggagattccccacaaatgcgtttaaaaatcttatagaagtaaccgacatttgtatatccaacttgaaaacaaatttcttcgattcccaactgactgttcaagagaagctgttgcgctaccttgattcgctgatgattgagcaattctgcaaaagtatgcccggtctcttttttgataagttgacctaggtaaaccgtatttaggtagagatgagcactcatatctttcaaagacagttcctctgcaaagcgttcacgaacaatcgtaacgacttcctgtatatgtggactgtaagtggaactctcggaaatttttttcagataatgacaaaaatactccattagttgatgtaaatctcgactcgcttctacctttacatagaaatcttccaagcgctgatggtcttcttcattaaaatagtaaaacacatccgacatcatctgattaaaaaattgttttgttaggtagactgccggagtggtttcccgtaatttatcagccaaatgtggtaaaacatcaacgatttttgccaatcttcctgcacgtagaagcggttccatatctttatagagttcagtggtagtagccgttagatcttctgatagttgcttataaaataagcgcctctctaccttgtcaatcaactgccgtatggtcatcgtcggggtaacttcttctgtatatagactaccctctggtcgactttctgtcaactgaaaatagtagacttgatgtaaaatatttttttcacgacagtagcccattgggtttggagtctctctagcggcaaaccatgttttctgggagtgacttaagaactcactcgctgtcagggttcctgccaagaagcccttggtgtattccctatctgtctctttcttcaaggttggtagctgttggagcagcttagccagttcttgtttattgatgggcttaaggagataatccattgcccctagggagatagctttacgggcatattcgaattcttgaaaaccagacatgatgataatatgggtatcaggcgattgttctttcattcgtcgaaccatttctaggcctgtcatatctggcatgctgacatcggttaggacaaggtccacagtatgctgtgaaaaataatccagcgcttcttcggcattctctgccgtataaacaatctcgacattgtattcatgataagggagaagatgcttcatcccttccaaaatcatatattcgtcatcaactactaacatcttatgcatcatgctcatctcctcgggggaagacaccttcaaataagattgaatatgtcaccccttccccttctttagaatctaattctatctggtaacggtctccaaaatagagaagtaaccgctcgtgaacgtttcgtaatccgattgattgtgaccgattttcttgcgacagttctcgacttgccaagaggtgtttgtaggcttccagagtttctgcgttcattcccttaccattatctctgatgagaatttccatatcctgtccatgcttgagagctttgacactaagcgcattgtcttttcgtttgaggtctactccatggacaaaataattttctaccagaggctggattacaaaacgaggaatttcaaccctttcgcacccaggatccatttgataggcataggcaatggaacggggatagcggatttgacaaatgtagctatgtttttcgcaaaatgaaagttcttctgccaccgttgtcatttttgcctgtgtcacactactgcgaagcaagcttgaaaattcataaatcatatcccctagctcatccatctgcttgctgactgcatacatacggaaaaattccaaggtattgtagagaaaatgggggttaatctgggcttgtaaggctcgcatattggcatctttctgagctaactgcaagcgatagatgtcttgaatactctggtccatagcatccagcatctgattgatttctgatgaaataagatacatttcctgctctttattgtccgtctgtagacgaagatgcctgtcttcgccacgaatctgttgcatggtatcaacaatgtccagtacttgaacttcatatcgtttaaacacccttctcaggaccagtagtaaaagagcaacgagacaactacttcctagaaaaatgattccgactaggctgccaactttttcaatagcatactgctggtcaactccaactgcaatttgcaaatccccactcattcgataggagagcggaggtgaggcaacatctggtcgcagactataaaattcccgatccagagaatcttgaactctaacggtcatggggagatccgtcttacgttgaatatattgttcgagcaaatccgcatcgatggtgacatagatggtcgcaataccttctgttgtcgatggagaaaataaggtcatcgaaatactatgttgcggagccttgtaattttcggccgtgacctttttaccagactttaagtcagaggtagaaacaaagacagtatttgcatccatcggagcaatatcgactccttctacgaagggataatagagatagagagtgcgaacagaatcctgcaaggaaatccgtttgaccatcaggtgtgggtgactcagtaaccagacctggtactgagaaggagataattgaaaatagtgataaaggctgtctagacgatccctgtccgtaatgtagtctgctagataattcccaacccgtccttgataataatccaactcctcttttagaccatctgctacttcctgttgaatgcggatgcgattggtatcatactgataccagctgatgtaggaaagaatactggcaaagaaaataacaatcccaatcactaataaagaataacttttcaaaagagtatgaattaaaacttttttcataagtaatccttgtcaactttcttataaactggatcaaaggcatcatagagaaacaagagccataggaccggtaggaagaagaataaaatcaagggaagcttgaatagcaagaccccacagacgagactgcctaacaaaaatttgaccagggctttccaatcaagaaaaagcgagacagccgccaactgtaagcctgtttttagactaaattcaaaatgtacttgaagttttaaaaagagagcatagagtgcaaaaatatagaaaagcccaaaagcatttgtaataagaactgctggcatccaccaggtctggggcaattgaatcaagagccaaatgccgctaaataaaagaccaatcaataagaagacaagaccaaggccaaggttaagccgaataaaatgctctttaaaatagccaaacgcctctcgaaaattatacttagatgcatccatatgatagttatcgtagaggtaaactatcgttccatttgctggtgaaatgcccagcactacgcctcctagcaatagaagaaccaaatagatggcactcaatttcatgaggaagaacagaagagtaaaaagcctgtctaaccaccctaacattgtatattcctccttttttatctattttatcaaaaaatcggtgcttttctaccatttgtcaagttcatcaaggtatttgacgaaaaatattttgtgtctcgtcatccaaataaggaaattgttttattttggactaaagttacgtgtaaaaagtgcatacaaaaccaacaccttatgttgaaattttttgataaggtgttacaatgatagagcataaacagttttaccgattttgggttgaagcgtaatcgtaaaatttgttatgcataatgaggtaatacattgtccgaatgagacgatgtatggaggcaatcgtgtgcagcttcgttgaagtcgtttgcgattgtctttttcgtttcttataaaagtctgcgatatggcaaggattggtatgattggctgaagcgatattgtggatacacttgaacagaatctttctagcgtagggattaccacgcttggtaatgtgttccttagcgaggaagttaccagattcatagtgtctcaggtcaataccgataaaggcattgatttgattggcagactgaaaacggcgaatatctcccagttcaccaataatacttgttgcagtagtctcagctattccaggaatagagagcagaatgtcatattcaggtaatggctgagctagttccaccatttcgtctaagactgcctgtctctgttcagaaagtctaagcaattcttttgtatagtaacggacctcttccagtattggagaggttttcttgacggcacaataagattgattagctagtgctataagcttctcggctaagtaagccacacgcttgtcagaaatccgttttgaagtggacagacggatgctctttgagagttcatcattgcttaactcaagtacgcagtccttacaaggaaaagctataactaagttccagtattgttcgccagatggtgtcgataagatattttccaattcagggaaagtgacctgtaagaccttgtgcaggcggtttttagctcgaacaatatcctcggtcagattctgatagaaacggctgagatcccgcaagttttggtagacttcttcttggacataagtgggtttacgattcagcacaaattgagattgagccagtttttcagcgtcaatttgatctgttttccgcacacgcaagctatccagttgcttcttagcttctaagggattaagccgtgtataagcatagccattatcatctagaaaagtttggagacggcgagaatagacacctgttgcttcaaagatgatttctggcttatggacggttctcaaatcgccaagtagccgagcaaagccgatggcgtcattggatatggtatagccatgaactttctcaccattgactagaatggccacttctgaacttgccttactcacatcaatcccaaaaactactcgcatgatattacctctttgtcttgaatgattccttgttttagcgatgtcattttcaatactcgacgtctggcgtcccacatactttgataacattctttctaaaacaggtgtcttgccagtttttgttgcgacgtctagcgtcaaaagcaccctcgacttaacaagacacctctactttatcataaagaaaaagtagtgagtactttctcccgtcggagatttcctcactactaatcttagtatgtttttgtatatattaacataaaataaatacaaaagaggctgagcaaaaagcccagcgccacttcttagagttcgtgtcgacatctcatcgcagtggttgattggcagatttgttcgtgttttacactccaaatccgacctatacgactgatgcgaacagaattcgcttcatctccaacctcaaactgtctcccagacagtttgagctgtgcgggggtgggagtgaaacagtatggggatagactgtttcagctcaacaacttaaaacgaaaaattgttgacgaactttttttagaccagtcgagttctttcccactccctcttttcacacttcatcacctgtatcgtattatttatttgctaaaaactcatcgtattgtttttgcatttcttcttttacttttttgtaggattcttctgcttccaattttttcagcatttctggaacagcaacatcaggatccacagtaccagtattgatacttgctgcatattggctcatgatattttggatacttgtaatttcagtcttaactgcatcagcattgaagttgaagccaagaagtggagactcttctgcacctgccagcaattcttctgcttttttcacatcttcatctgttaccttgtcagtgatgtagagaatttggctgttacctgtgttccaagctgacatacgagtatcgcctttgtaaccatccaacaacttgatacgattttcagcacttgggtctttttcccagttgactccctctggaccaaataccaagccgttcagcaattctggatttgtattgataagggtcaatacttccatagctttttctttgttcttagatgtttttgaaatgacaaagtttgctacttgggtagatccgcttgtcttataggcagatgtgattggtttagaagtaatcttatagcctgcaactgttgaaaggaggctatcgccaaagtcagctggtccttgtgtttcttcacgaacgaaccagtttgctacatcaagtgagaaggttgcgtcagtagtcgctgcatctgccataatgtagccagccttatagtatttgtgaatggtacgaaggttatccatgtgacggtccacttcaaatgggtttaccacttttgtagtgtcgcctttcaagtcgatagcaaatggtaactcattcccagctggatattccaagccgtctgttgagggtttgctagattttacccaggcaaatggtgttacatctgcttctttttctttgatggttgccaacatgctttccacatcatcgtagctatctactttagaaatgtcaaaaccatacttatcaaccatgtcttggttgaaggaaagcatctgttgactagctacgttaccgatgacagggactgcgtagatttttccgtcgatggtatttcctttgatataggcagggtcaataatgtcatagagggccttgccttctttcttgtaaagttctgttaaatcagcataagctcctttttgcgcattgataatatagttgtctgcaaaggcaatatcatattcctcaccagatgaggtaataatggccattttatctttatagtccccccatgagatatacttgatgtctagatgggcccctgcttctttttcgataatcttattggcattttccaaaagaacatcgatgtttttcggtgcgtctccgatttgatacatgaggatgtttgtcaatccatcttctgttgtagtgctacttgatgcggtcttatttccagtcagactaccacaagcggcaagggcagctgcggacgcaagtgtcacgcaggagtaggcaaattttttccatgttttcatttggctgttcctttctatttttttagataatgaagtatggaatacgattgttaagatagagtgatgtctctactccttgactccgccaattgtcaaacctttgacaaagtaacgttggaagaaaggatagagacaggcaattggtagagtcgatacgaccacaatagccatacgtgttgcttctttgggaagggcccctgcaacttctgaggacatggccgctgctgcggcagcattttcagagagatattgaatgtttgcttgaattttcatcagcaggtattggagagggaagaggttatcgctctggatatagaggagagcgttgtaccagtcattccaaaaagcgagggctgtaaagagagcgattgttgcgatacctggtagggttagtggcaagcagatttggaagaaaatccgaaattcactggccccgtcaatcctggcagattcgataatagactcagaaatagtctttctaaagaaggacctcatcaccatgatattgaaaggagatagcagcataggtagaatcaaggctgccactgtatctttgagatttaaaaacgaggtcataacgatataggttggaatggtccctgcgctaaacagcatggtaaagagagccatcagggtaaaaaatcgtctgtatctgaaactgtttctcgaaatggcataggcgtaaagaacggtgaagaagacattcaggctcgtccctacaatggtcacaaagaaggtgataaagagggcttggagaatctgatcttttaattgaaagagatattcataacctgccaaactccattgctctggccagaaagaatagccgttgatagccaagcttgtctcatctgtcatagaaatgatgataacaaatatgaagggaagggtacaagatagggcaaatatccctagtaaacttgagaaaaatagatctgttttcttactaaatgaatgaatagaaacagaagtgatttgtttcttttttttcatactcccctcctagaataaggctgattccttatcaaagcgacgaacaatcaggttggtcactaccaccaagatacagccgacaacagactgatagagacctgccgcgatagccataccgatgtcccctgttcctgcaattccacgataaacgtaggtatcaaggacctgagtcacattgaagagaggacctgaatttttcggaatttgatagaaaaggccaaagtctgctcggaagatatttccgacagccagaatcgttaaaatagtcatcagaggcattaactgaggaagggtgacatagcggatgcgttgccatttggtcgctccatccacaatcgcagcttcatagtaggttgggtcaatgcccataatggttgcataataaataatactgttatagcccaaacctttccaaattcctaagaaaagcaagatgaagggccaataggttggtgtgctgtaccagttgatgggatccatccccattcctttgagaatattgtttatcaatcctttatctggactcaaaaatgcgtaaacgaagaaactgataatgacccaagaaaggaaataagggaacaaggttgtggtctgatagatctttaccagcttcttcgaccgcatctcactaaagataatggcaatacctactgcaaaaatcagtccgagtacgataaaaccaagattatataggatggtatttcttgtgatgatataggcatcggatgattgaaatagaaatttaaaattatccaatcctatccacttactttgtatgagactatcccaaaagccattacctgtatggcgatagtccttaaaagcaatcacattgccaaatactggaatatagaaaaatagaatgagccagatgactcctggcaataccattaggaaaaaaatggcattttgttttagattttttatgaggtctttcatcatagctcctttctattatgaacctttacattattagtttactcctgattgggccaactgtgaattgccacattataggcaaaattctacaaattataggtgtatataacaaccgatataccttctgtaaaaaacaaagaaaatctgggttgctaatcaaaatttgcataaaaaattgagccctttcgagctcgagaactactaggtcgtatagatggttgaagccgtcgcaataatctgccattggttggcagttgtcgcaataaatcccttgtcctgatggaagtcatcgtaagggagaattggcacttctagttcatctagtttaggtacttcattgttcagataggcttgcaaccgctggattgctcggcgaatgcgggcatccaatccccctaggcgaatgtccaccgtatccagaccaaacaccttcttctctaccatccattggtagctaagtgcctgatagaagctttccagatctattcttagttgctgcaaaccgtcaactttctctgccaagacctgacgatttccttcctgataggcctgacgaatacctactgaaatagccgccttggtcgctaaaacctgacacaacttagcctgagtatcaaagagataggcatagcccttggctcggcttccaatctctgccaatctaggcgctaattcctgataaaaggcattgtctttttcggcatcaatatgctcttgcagcaaggggcagagaatatcctgatacaaaatgtagcgactgggattgaaaccgtgatgacctggacctgggtgactaggtgtcttatttggcaaatccaattgcaggaagtcatctagggaaacttggtgtagttgatagaaatgctcagccagacagcccaaatttcctcggtactggagttctgcccaggcatgaagactcggcaagatcgaaaaggttgcgcattctccaccattatctccccaagcggtcaccgtcacttcttggacgccatactcttggcaggcagcatgtgcttttggtgcaatccgcatactgaaatcattatcaggagtaaaaccaatccacttccaggcaccacttgcaaaggcaatctgatctcccaactgctgatgactagctagtttttgaccatagctctcacgactagtctgatagtaatcccaataaatcaaggtcactctgtccttgagacgatccaaataagcctgaatttccgaatcaatttccaactgaccagtataatccttactcgctgtcaacaactggaagaacatatcgctccacatactacaatggaagccgtacttgtcagcaatatccaagacccgttccaagtgttggcacataatcagacttcgtttctgatagccgtgttgattgaggtattgacccagcccgaccaagtgagcctcatccataccgatgttaatggtccgtgttttcagatgggacaaagcctcaaacatcttatcaatcaaggcataggtcctctcatccccaatcaagagaatattatccacatctcgaatggcctgaatagatgaaatgttccatttgaggtaggcgatcagatgggccaaggtctggatacagggaataaattccataccgtaacggtggcactcctcctcaatagcctgcaattcttcttttgtataggcccctcggaaataaccaaaatagggttcatcacgtagttggtaggtatcttccatgtaaagctggaaatggctgtagcctatcaaggccaattgtctaatcaagattttactggcttcaaccgtcaggacagcatttcgagaacaatcttccataaaaccgagttgacgataggcaggtctttctagaatctgtatgtcggtctcaccctgagccaactgactagccaaaacaagcaagcctcgataaatcatgtgttctttaggcgcacggatacggtaagaacctgctgaaccttcaatccgcaaactctccttgccaccgacttcaagttctaactggcaatccaagccaagcgaggaacaaatctcttccaagaccccctccgactgccgtaacgaatggtttatctgtaacatcatcatttctccttattgtagggtcttcatataagcacccatgagattggcatcctgctggtagtggcaggcacgaatggcaggtagataaggaaattcttctggatattccttttgaatagcctctagttgctcctgaatagcttggataaagactggattctggctgatagagccacctatagccagcacttctggttccaggaaataggagatatttaaaatgccataggccagattgcgtgtcatttcttcaatggctaattgacatacctcatctccctgttctgctagctcaaaaatccgcttgccgttccaatcttccacagcttcctcatactgactagcaacctgtctgaccaaacttccagtagaagcaagttgggaccagttttttagaggtccctttccagtagcaatcagcatatagccaaattcgccaccgaaaccttgtttccctcggatgagttttctatccacaatcaaggcaccaccgatacccgtaccacagacgacacaggcaaaagtcgataactggtcatcaacagccaattcactcagaccgacacaattggcatcattttccaaataaacaggacagccatactgacttaatagctcataccaagatacaccatggatataaggaacggcactcagcccctggatgacacctgtttcaaggtctaccgctccaggtatactgagggaaatagcctccaagccgtctaccggctgaataacactgtccataagcgccaacaattccgctaaactagatggcgttttccattcctgcctatagtttatctgcttatctgaaccaatcagggccgcctttattcccgtaccaccaatgtcaaaacaggctactaccatgttctttctcctttccatgatgaccaacgacctctgttcggattgcctgtgacccaatcctagccggcaaatcctctagtggttcttctagcaaatcaaccccctcagtccactcgctccaacctgctaactgctcctgactcatattgtagtaacggagcagaatgcggtccgaagtctctgccaccttcaaagaagtcacgcataagcggtcctcttccagtgctggatggctcaaaaactgatgatcacacggcagatgcccactatggctagtcaactgtttagttagcaagtgtccttggaaggcctgcgctctttggaagctggcaaaaccttcctctactgggcaaatttcaaaggcatagtccaactgacattccctcaaacactgggcttctggtgttgggaagtagccccaatctcccagctctccagtcgcacgaagcaaggtaagagctatttttcccttgtctaggatttcatactcatgtaggcccttactcgaaacggtcatggcttgtcgaccatctgatagactaataaaactgcgatgacgctgaggattggacggattttcccaggctggatgtggctgatttggacgttcaacgacttcaaagatggaatccgccaagtggttctcagcttctattccaatatcaaagactgctcgcaagcgatggtccttgatttggttgtggaaatcggtctggatgcgaatttgggattggtggcggtagagtgtcagataggtggtaaggagcaggtctttcttttcctgactcctttgagatgttcgatgtttaaattctaccaggcgcttctgttcatcttccagacttgtttccatagctacaggcagctgcagacggtgcatgaccttggcaatgctgaccgcttctgtttggtagacaagaccgaagtactctatctgaccatagatcggttggtcattcttaggcgccatgaagatatattcattgcccaaatctccacaatcttcaaaccgtagccagtctttataggcttgacccgttctcttatcttctagcaagagctgaccatccatcacattgatacggtaataatcattctcgaactgttcacttaaactgctattcaccctagtgtcaccaatcggcttgacttgataggtctgccatgaaaatggtgcttgattttccactacaaagcggacacgaatctggcgggcaaaattggcagagcgaaaagcatcttttggtaaatcgtagcggaagttgacacctagatcttcaatggtagcttctacctcttggccttgactggtaaagaggcccaaggctggcagagaaatagctgccatggattgaaagtgttgttctaactgcccatctcggaaatcctcctgttcaacaagcaaatcaacctccactaactgggtttgtcggcaggctgtagtattgaaaaccgtaaatagtaagccgtctaattggctagaatccacctgcttttcccacctgtctagggagcgctggctcaagaaatgagcgacttgcttgaccttcttaaagcgggtttccatctcactatgcacctggtctacgctacaaccacagatgctatcatgaggggcattctgcaacaagagtttccaggcatagcgcaactcatctctgggcaccttatctcctgtcattaccaccaagggttctacaacttgttccaagagctgactggcttggtcattggcctgcttgagataaattctcgaagaagccgtatttgccaaggtgtaccagccatccgtttcctggctaatcaattctcccttgacacgactgaggtctactggtaactcttccttgacagctgcgatatattcttcaaagcttgaatgaacaaagtctatatctggatacagttttcgggccagtcgtaatgcttggctgagatttttctggacaggctggtggtcacagccattcatcagcagatagtgggaggttgaagcgtatttgcgaacatctgccaattttttctcccagaaaacacgtgcttcctcctcatcaactgggatttcattgccattgctgtaccagttagcaaataaaatgcccagaacctgactgccatctgccccctcccaaatcatctccgagaaagtggactggaattggtcatctcccagaacctgattatcaaagccaactggtttgaccccacgaccaaacaaggccacatctataccagcctgacgcagtagctgaggagcctgtcccatattgccgaaagtatctggataataaccaatcttcggagcccgtccccacttcttgctttccaaatgacccagaagggtatttcgcatattggcctcgctggtgatgaggtaatcatcctgcaagatgtaaaagggaccaataatcagccgaccgtcttgaatatatttcttcaataactctcgattctgcggacgaatttccagatagtcatctaggacaatggtctgtccatctagatgaaaactcctaaactcaggatctgtttcaaataagtcaaacaggtcatcaaatagctctactaagcgcatccgatgttcttccaaaggaagataccactccctatcccagtggctatgtgaaataatatgaaccgtttcttttcccattttattcctccggtcgtatatcataataatctaaaaccaattcgcaaaacatcatatttgcccaggagaaccactctctagagtaaagcgtcggatcatccacatggaaactctcgtgcatcagcccagtaccgccatcacaggctaccatggtatccagcaagcgcgctttttcttccttgtcatccgttgtcaatccttgaatagccaaggcaatcggccagatatagcgatagaaggtatgactggaaccaagacccgcagcatagtctccctcgtagtaatagggattttcttgacttaaaatagtccgacgggttgccaaatagatgggatcatctttctgacagtatcctagatagggagccgccagcaaactcgggacatttgggtcatccatgatagactgattgcccaatccgtccacttcataggcaaaaatagtttctcccgcctgattcttggtcagcccgaaggtccgaatcccctggtcaatttcctgcgccaaccgtctggcaccttcagccaaatctgagaattcctcacttgcaaactgctctgctatttctcctaaataacccaagacgacgaccgcaaacatgttggaggggatgaggtaagggtagatacaggcgtcatcgcttggacgaaaaccagaccaagtcatccctgtataggcgcagggagccccttttccttggtgcgtgagggtatcctctagccggtctgtatcccgttcaaaactataaggggagttttcatggtgctgctccaatttccagagttgaacaattttttcagctgccccaaagaaggtctggttaaaatgactggtttcccctgtcgctttccaaagtagataggctaattgaaggggatagcagagggaatccacctcatattttcgctcccaaatccaggggcctatctgagtgtggtcggtctggtgcccccgcccattagctgcctgattaaaggcattggcataaggatccatcaaaataaaggccatttgcctctctaccagacctacaatcatctggcgtaatttctcatcttttctagccaaagctaaatagggtttgacctgggctgtcgagtcccttaaccacatggctggaatatcccccgttaagacaaaagtagtcccatcttccagctgactaatggtcctatcaagcgtatccgtataacacctttcaaatacactcccccaacttgggtggtctgctgttttcttctgaatgcctgtcagccagttctctatgatttcttttgtgtaaaacatgatttctcctttttatcctttgctcagagttcttccaacctctatctggcaaatccatataattttcattagacacaaggttcctagtatcagtctatacaattctatatgcaaatcctatacacaaattaaacgcatttttacacaaatattgccagtttcggaaaacgctttcctttctttcccattctctatataataaggagaacaccacttattatcaataaaaaaagaaaaggatagcctatgtatacctccattgtttcaaccattgacacccgctatggtacttataactcacatgccttttcaaacggaaacaccctgccattgataggggtccctttcggcatgaattattttgctccccagaccagcgaccagactggaaactggtggttcaatccctatgaacctgtctatcagggcattcgcttaacccatcaacccagtccttggttgggagattttgcctccctcctattgacgcctgtcacaggcgaattaagccgagatagcctctttcaccgtcaatctagctaccaactggatcaggctattttccgacctgatctccttcaattacaatccaatcgctatcgcttgataagccgtttagctcccagccgatacggagccagttttgagatagcgtcttttgctaaccagcctatcggaatggtcttctattcatctggaaaatccatttatcgactgctcaatcctcaccaattgctcattcagatttttcaggtcagcgcctgccaatcccctgatttctgcatgtatgctctcctagaatttgaagaggaaataacagaatgttatcatctggtcaaggatcgcaagatagctaaaacggaagtggtgggagaagatttgcaccttcgcatcaacttctcaagcacttctatcaaggggcgtttggctacctcttttatcagccctgagcaagccgcctttctattaaaagatgttcctgacttccttcaagcccaaaaacaagcagaaaacacctggaatcagctcttaggacgtattcagattcgtgacaaaaaaacagaggacattaacttcttctaccactgcctctaccgttgcctcctctatccacaaactttctacgaacctaatcctgacggacaagccattcatttcgaccctatcagcaatcaggccaagctaggtaagtttttcaccaacaacggctactgggataccttccgctcttcttatcccctgctttcacttatctacccagattatttggaagagtttctccacggcattctccaacactatcgagatactggatttttacccaaatggctatcgccagacgagcgcggtatcatgccaggaactcttgtggatggagtcattgctgatgcggcctgcaagggacttgttcctgatttgatggaagattttctccaagccatgattgaaaccagtcaaaagaccgatgcggatcaacgttacggccgccatggtagtcagatttaccgccaattaggctatctccctctcgatttcaacgaatctgtgagccattctcttgattatgcctacagtgattgggctatcagccaagtagcagaaaaactgaggcaggaccaactggctaagcaatacgctcaaatgtgcctcggctaccgacagttattcgatagccaaacaggtctcatgcgtgccaaggatagacagaaacaattccgagcagatttttcccctctaagttggggaagagactatgccgaatgttctgccctacaggcaaccctgtccgtctttcatgacatcgatggactgatagaattgatgggcggaaaagaagccttcaccaactatctaatccagctctgtaatcaggagccctatttctcacctgaacaatacggctacgaaatccacgaaatgtcggaaatggcgcaagtcaatctcggtcagcttgctatttcaaatcaaccgagcttccatatcccttatcttttccaatggtctacaaaaccggaatacactagtctactcattcacaaaatcagacaaacagctttcaagacaggttttcaagcctatccaggtgacgaggataacggtagcctttcagcctggtatattttctcctgtctaggcttctatcctgtctgtcccggaaaagctgactaccaaatcggactaccgcattttaaggaagtagacttgctacttgcagatcaacacaagctgaccatttctactccaaaaagcgatgcaaatttccagtttgtcaagcaagtttcattagacaaacaagtcgtccaaaccatcaaacatgaccaactgataaaatcaaactgcctagaatttgacctatctatattaccaagtaactaaccagcttctacaaacaaaagaaatagtcaggaccaagcctgactatttcttttattcaccttgctttctaagcttagctaactgagataggccagccaaagccacaccaattaacccaagaaagacatacttctcctgataggtatcaccagtttgtggaagaccactcttctgcagagaagcatctctgatctgcttttcaacctgcaggctattttccaccattaaagtcttctcttgctggataggcaaaccgctgccgacctccactattttcggctgactctcatcagcaactattcgtgaatacagctcgcgacggccatcactatagactaggtgagctatcatcatttgaccatcagccccctcctgaacaattcgctctttgcccagtggcaaatcagtgctggtccgtgtgatgatttgtctcggcaccagctcataggtcaaatccattctcggtttttcaggagctagtaaattcttagactccatcgaatctcttgtaccgacatgagttaccagactagactgttcaaacaaatcagtccattcactgagcagctccttcatctcatctggacgaatactatccgaacccaaaattttctcagttttttcaagtaaagaacttagctcagaagaatttataggtctatctattcctttcacctcttggattagctgattgagacgcccaagatctgcttggtaaagtttctccccatccagctctcctaactgtttctctaaaagagtttgagcggcttcaacctgctcgactgtccgattggtatctgctaccacagacttagcttcttccaaggctgtttgcaaggcaagttgtgtctgctcactagaatagagataggctgtttgggtttgtagagcctcaatttctgctattttctgctttagatactcatcattgacgattggcttcggtgaaacaaggacatcaaatgaagtctccaaaccagcataccgcaaacctaggctctgacgcccctctttacgggaatcgaaaccaacaatttctactccagcttctgtcaaagagaaggactgagttgactcatcgtcatagataatagcaaatcgaccatttgtgacatccaaatcatctcctacaacatactgcacttttggtaactgttggatttctagaccgactgcttttttctcaccctgggctatatcttcaacaacatataccatcagtggctgagcaagtgtttctcctagataggaaacggtcaatgtttgttcacctaatttttgcggatcaaatccccttactgtaactgccggattggtggtattcacccgttcagcaggccaatctccttcaaaaactacacggaattgtgctcctgcaagcgataaaggactaccttgtcggtaaacttttttctctaggggagctatccattccatcgctttcacgactttttcaccttgcggaacgcgaatggccaatagattgctccaatcctttccttcctccagagtacggtagtaaatgaactcaggcagggactcaaagcgaatcgggtcgaatataagatttcctgactctgtcgtttccaattctgctagtggttttacggcatctggactagaataaagcgctattttccgattggcagggacatccttgaaacctacttgaatctgatgattaccgagatggcgagcaacagcatgggtcatcggaatatttggtgtctccatgtccaattcttcatacatacgccaattataaatacgaatggccttccaaggagtaccattatcagaagtcaagacatccaaacgccattcctgcgctcgaattggcttgtccaatacgatgtctgtcacatgatcacgattgccacgaacttctttggctaacacccaatcaccattctcatttttataatagagatcgaaatccttggtgttcattaagccatcattgaccgattcaccacctgcaccagcatgatccatagcccatcgcacgactgtccgaggttgggtcaaacgaatatctacatggccactcaattgatgggaagaccatttatctgacaaactggtaatggtcccattcaacatgccctcaatgccttctccaccttcttttttagcaaaacttgaaccgatgacttctgctccgagaacaatgttttctgccgatggtttaggaaggctagtatctttcaccgtcatctcccaatcaaagataaactcccctgcttccgaacgcaaaccatttttcccaacggcatgaactttcaaagcttgggttcgaccttctgcctgtgcagaacgaactagttgagggaggtaaatccttgtattagaagaacctgtcagcaatttccactgtccgtcaacctgcgcatatacttcataatagtctgcatcatctgtccctgtaaagctaatcacagcttcagcatcttgggcattcttcaatcgcttagcaaggacttggccatctttcggtgcagtaggtgaattttcttggtcataaatagccaactgccctaaacgaaaatcaaaatctgacagcgctgcttcattttcaacaaccacttggataccgtacactgtctttcctgccaaactagataaatcaaaggtctgatcttgccaatctcctgatagtttaagcaagcgccacgcttctttattcgcaaattgataatctggttcaagcgctagagctagggagatatttgcaccttgccctcctttgtgcgcaacccgtaaacgacttgtttctgatagaggaatcttggtggaatacaacttaatttcctgcttaccatctttttccaaatcgcctgtaaaacgaagagagttgcccccattataggcatcatcaaaatcataagccgcagcaagcttttcaccacttgcttcaatccaccaccgccaggttggtaaaataccagacacagaacgataattccattccccatctttggcaaccttgccatctacaaaccattttttcccgtgccctgtattaaaggaactattgaaattactgcttgtaatagccgtcttatccgcaatgagattggccaagccataccaatttttatccgaaggtttctgtttggttggatcaccttgatagcctgtaaagaagatattctcattctcatgataatcctcacccgtcgcacccaaacttgtaatggtatctggcgcaaacagaccgagtgataatttcaatttcccgttttcatcaaacagagcatcccagttaatttgcgttttgtaagagcctccccgttgcaattcaaatccagcaaaaatatcaaatggatttcgaccgattcgtttcgccacttcgattgaatagttatttttggcccgtgtccagttaaaattcgcaaagaaatgatccgcagggaccttgtctccttccttttccataaacggatagttgtactcacccaaaccatcttcgtgatagcgaccatattcgtaggtcatggcatcataccaagaatacgttatcggataaccaatcgattctgcatattccttggtatagagcatgaagtttctcattgtttcccctagtggttgaaccaagcctcctgtagtctcttgatttatgaaataaccatcgaaaccgtagtatttagccatatctaccaacttacgagcaacaggaaaacttccatcaggatcctgtctcatagaagatacaaacttctcttgatcttcaatactactggaccaattgtagaaaatcgttcccaaaacaggcacaccattacggtgtccagcatcaatgacgtctgggctaggaatcaagccttcccaaaataccattgaatcaatatactgccagtaatcaaaggcataggctttaaactcttctcccccaacagaggcatggtctttcgccttagagttggtatttgaaagagcttctacctttgcattctcattggctctctcattgacgacgtgccctctaaagcgctcaaccaactctacagaagcgcggttcaaatcatcatctggacgagcacccggctcccaagcaagcacctgatcccagttgtcaaacttaatctctttcggacgaattccttgatcctctacctgaggaaaatctgaaagcaacagaccagaatctgaagaatctacctctttatcttccgcttcctctgtatcctctagtttattttctggattatcagacggagctgaaggcagtttttcttctctactatctgatacagatgcttctccattcaactcttcggtcaccgctttctcgtctgctgaaattggtgacattccttcttcagcttcggtcttttccacatgttcgttcactacggaagagagttcaacagctggctctgacaagctgtccacattttctagctggtccgcagaaacctgtgttccaaataaggtcgcaccaatcaaaacagaacaagcacctattgtaaattttcgaataccgaatcgctgacgtttgtcgaaatcacattttgtcatattttcctcctacacaattgtagtgcaacagctgttctcaatttcctcctttccagatcatagttggcacatgctacctttgatagaacagctatcacacgaagtttatcaggttttattaattccattgtacagaggaaaaatatgaccttcaagccctcatggttcccttctttaaatcagataaaaagaactttagtttagagaaaacaaaaaagaggaagtttccctcctcgttgtcttcgttaattattttctacaaacttaatacaccaacctaccagttcatccaggcgttccatctgctctgtcatgtgcaggtagcccaagaccgcctcaaagcctgtggacatccgataggtgaccacgtccgcattcttggccttggtatggctattggtattgcgcccccgcttgtagatttcttcctctttttcggtcaatagctgagcttctaagagggcagaaatcaagcctgcctgagccttggccgagacgtatttgttagcctcgccatgcaatttgttaggcttggtcagtcccttgaaaatcaagtgccgtctgatatacatggaatagacagcatccccttcaaaagccagagcaattccattgatgagattgacatctactgccttagtcacgtgtccacctcacaccatccttggtatccaagagcttgatgccctgagctgccaattcatcacgaatacggtcagccgtcgcaaagtcccgattggcacgcgctgcttgacgttctgctatcaaggcttcaatctcgctgtccaagacttcttcttcaaaaacaataccaaagacggcgagcatcttgccaaaggcttcttttacagtttcatcgtagttgcctgagttgatccatttggcaaagtcaaagatagccgtaatcccgtttgctgcgttgaaatcatcatccatggctgcttcaaaggccgccagatgtaattcaagagctgacttatccacagagttttgcacaggttgtgtataagtattttttagatatttgagattgatttccgcatctgaaatagccttctcagtgtagttgagtggacggcggtagtgctgggtggctaggaagaagcgcaagacctgaccatcaatttgttccaacatatcatgggctgtcaggaaattgcccaaggacttggacatcttctcatcattgatgttgagcatggcattgtgcatccagtagttggcaaaggtttgacctgttttgcactcagactgggcgatttcattggtatggtgaggaaattccaagtccgcaccaccaccgtgaatatcgatggtagctcccaaaatctctgtcgccatgaccgaacactcgatatgccaacctggacgacccgctccccaaggacttccccaagaaacttcgcctgacttggcagttttccacagggcaaaatcgaaaggatgttctttcaattgaccttctccctcaacacgaccagaagccccaacctccaagtcagatagggttttgttggccaaacgagcataattctccaccttttccacacgaaaataaacatcgccagccgcttcataggcgtaacccttgtcaatcaagacctgcacaaaatcgatgatttcatccatgtagtcgataacgcgaggatttttggtagctggcttgacacccagttttgtcacatcttccttgaaagctgcgataaatttatcagacagttccttggttgtcatgcctgcttcattagcagctttgataatcttgtcatccacatccgtaaagtttgagatgtaggtcacatcatagccacggtattcaaaatagcggcggatggtatcaaaagccacgacactacgggcattaccgatatggatatagttgtaaaccgtcggaccgcaaacatacatcttgaccttaccctcttccaagggcacaaagtcacgcagactgcgagtcatggtatcgtaaattttaatcatagtttctccattacttctgagtattctttaggacttgatacttttgatacaattttactagccaataagctgtcgcggccaaccaaatcatccctacctgccagcttccttgggagaatttaaggataaacatgattgtcccagcgatggcggtcaacacataaggccagttttgtcttactaatttttttaacatgatctactttctaattttcttgcaatggccatggccacttcaaagaaggtcatactgtcagccatccgttcctctcgacgggcatcccattcattcttgtggtggtccacatagtctgccgtgtagaaaaattggtagaccttggcctgacgaaagtttgcccaggccatgatagcagaagcttccatatcgaccaccatggcaccagcggctaggcgacgcttgaccttggcagctgtttcccgaaagaaagcgtccgtggtccaggtcttagcccgcacgtgctcgattcccgcttggtccaaggccttttccatggttaatagcagagcagggtcatagctgatttcctcgctagcaggtgcgtagtggtaaccagttccctcgtcccgaagagcagagctaggaaggatgatcttatccgcagcgagcgacttatccagcaccccacaagaacccagaacgataaaattctcaaagccacaggctttcagctcttccagatgaccaactgccattggagcaccgattactgccaacatgaccgcaacctgcagtccatctctttccaaaatataccaaggatggcgaccatttaacgtctgaagatgaccaccttccctgctttcagctagctgacttactcggtccacgatttctccattgaaggagaaaatcatcgtctcacatacctctccaccaccacggatagccttgtccgttggttcaataactgcagaggtgttttcaaattcttctagtagcatatcagccttctttcctacaaatgcgacgaacgatggctggcttctctcaactctgctaattttgtcgtgtagtgttcacgaccatcttccatgtcatgaatgatcttctcatctttttgaccatgaacacggacgattttagccggcataccgaccactgtcacatctgctggaacatcggctaggacaacagcagcagcacctactttcgcattttctccgatttcaactgggccaatcacctgggcatgagcagaaacgagtgccccttttcgaactgttggatggcgcttccctgtatccttgcctgttcctccaagagttactccatggtataacattacaccagattcgacaattgcagtctcaccaattaccaatcccgcgccatgatcaataaagactcccgaggcaatttctgcacctggatgaatttcaatgttggtccaaaaacgccaaaactgactgtgcatccgagctaataatttaaaaccattttgccacatccagtgagagagacgatgagcagccagtgccttgactcctgggtaggtcaaaaggacttccaaggagttccgtgctgccggatctttttcttttacaatttctatggtatccttccaccaacccatgacttctccttctagcgagaagacaagtccatttcgggacttgcctacttcaccattattttttatctactttatgaaatttaaattcaccaaagttattatcttttttctctttgtgttctttatgacgacgaggtttttctgaacgttcacgtttttctggttccacgtagccttctggttttggtagaagagctttcatagaagcatcaatacgtcccttatcatcaatttttatcaccttaacatctacaacatcgccaacctcaaccaaatcttctggtttattgacacgtgtccaagccatttcagaaacgtggacgagggcatcggtcttgtcaaaaaggttgacaaaggcaccgaatttctccaaacgaaccacttttgcttggaagacttcgtccacttttgcttcacggacaagaccagcgatgatttcttttgtgcgctcaattgcagcacggtctggtgagaagatcgccacaagaccgtcttcgtcgatatcaattttcacgccagtttctgcaataatcttatcaatggtttcaccacccttacctatgacaatcttgatcttgtccacatcaatcttgatagtgtcaatcttcggtgcagttggtgccaagtcaggacgaacttctgggatagtcgcttcgatgacatcaaggatttcaaaacgtgccttcttagcttgtgccaaggcttcttccaagatttgtggtgtgataccgtcaattttaatatccatttgaagggctgtgataccgtcacgagtaccagctaccttgaagtccatgtcgccgaagtgatcctcaagaccttgaatatcggtcaagacggtgtaattggtaccatctgagatcagacccatagcaatccctgcaacgggtgccttgattggcacaccacctgccataagggcaagggtcccagctgtgatagatgcctgtgaagaagaaccgtttgactccaagacttctgctaccaagcggatagcgtaagggaagtcttccaagctaggcaagacttgctcaagagcgcgctcaccgagagcaccgtgaccaatctcacgacgacctggtgcaccgtaacgaccagttgagccaactgagtattgcgggaaattgtagtgatgcaagaagcgtttcttgtactcatcatccaaaccgtcgatgatttgggtttctcccattggtgccaaggtcaagacagagagggcttgcgtttgaccacgggtaaagagacctgagccgtgaacatttggcaagaagtctacttctgcatccaaaggacgaatctcatcaacacggcgaccatctggacggaccttgtcttcagtaatcaaacgacgaacttctgtatgctccatgagttccaagatttcatggacatcacgcatgatacggtcaaattcttcgtgctcagcgtatttttcttcgtaagttgcaatgacagtctcgcgaacggcattggtcgcatcttcacgggccaatttttcttcaacctgcaccgcttttttcaaatcgtcattgtaagctgcaacaatctcagcctgcaattctgggtccacttgaagaagctccacatctgctttttccttaccaactgctgccacgatttgattttggaaatccaagagttcttgaatggccgcatgacctttcaagagtgcttccaacatcacttcttctgataattctttggcacccgattcaaccatgttgatagcgtctttgttaccagcaactgtcaattctaaaagggaggcttcttgttgagcttgatctgggttaataatcaattcgccattaacataaccaacctgaacaccagcaattggaccattgaatggaatgtctgagatcgctaatgccaatgaggaaccaaacatggctgccattggagcagatgcatctggatcataagaaagcactgtgttgatgacttgaacttcgttacggaaaccttccgcaaacattggacgaatcggacgatcaatcaaacgagctgtcaaggtcgcatcagttgacggacgaccttcacgcttcatccagccacctgggaatttcccagcagcgtacattttctcttcatagttgacttggagggggaagaagtctcccgtcgccattttttttgacataactgccgctgtaagaactgtggaatcaccgtagcgaacgacaaccgcaccgttggcttgtttggcaacttgacctgtttcaacgaccaattttttgccagcaaaaaccgtttcaaatacttgttttgacattaattgtctcctattttttctgaaatttttcttgcgtgttttctacaaaagacaatcaaacaagcttgtttcactctcttttgcacaaaaccacgcatactccttattttatcatattttaggtagaaataaaggcctgaaactatttttgacaagaaaacatactcatgataaactattcaaaatagttggaggtagaaaatggaaacttgccatcttgtagttcctagtttaaaatggaagaaccaaatcctagcctataaagaagcatttagcaatgaacatcttcatggtggtggcaaactgcaacaatttgaagcagttgaggaatggctagaacacattaaagctgtgtcatcttatgggacaaatcatacagaacgttctccttcttctacatttctttgtattcgtgaaaaagatcaacagatggttggcatttgcactattcgccacgatcttaatcacgagcatttaaagaattatattggtcatatcggctattctattcacccagaagagcgaagaaaaggctatgcgactgaacaactacgaattgccctgctggaagctaaaaaattgggaattgcccaagtcttaatcaccgctgcagattggaatattgcctctcaaaagaccatccttgcaaatggtggagtttatgaggatacccgtattgaccctaatagtagcgagcgtatgctccgatattggattgaaaatttgtaatataaaaacctccaatgatactaaatcgtttggaggcttttttaagttaccgattattgaactctcagaccaaatactcgttttatataaaggtaaaatgaaatggatgtttcacaaaatctaacaaagggacatcgctttcatggacatggccaacaaccatttggcggtcgtcctgaggcaagtcgaccaaacaaatttctagttctgattgataacgaagaaactgttcattagcaagaacaatatctcctcgttttcgatgacttgctggcccttgaattgcatatccttttaactgagcccttgaatggctagcacgtatgacatattcactgcatcaattctattttcgaaattcattcccttcaattgctttggaaactgcgctgataaggctattataccctttgtcaaatatgaaaatctttctaatgaagcactcgataaggcattatccccaatacaaacataatcactttcacaacacatcaaacaatcgagtgcggcttgaattggaggcaacgctctatgttcttcaacggttggaagtccttcaaaaagcggaaaacgcttgttatctccaggaataaaggtgatgacttttattccacaagagtgtagccgactatttaggtcacggacactacttccccctaaacctgtataaggcttaggataataattatgacatgccaaaacttttgttttctcaataccaacgtccatcatcttccttaaaaaatcatctgacaatgtagatgcatttaagacaagtaaaaagtcttccgacaatgatttcatgacttcaatagtaattccatcatcaatcctaagtgctttaataccgagctttttaatcccttcattcccatatcgcttcaaactatcttgattgatatccacaatcaaggtcagcccttctcgttgacattttgttacaatatgacgaatcttttcgtctcccttctcttcttcatttatattaagcgaagagaaaacaaaggaaaatcctgcattttgatattctataaaccacttttccgaattagcaaatgagttagataaatagagtgaaaaaccgaaacgactgaaaaaatcattaacttccatatacggtctcaattctatcttcatccacaccaaagaaccaagttagtacaaaaccacctacatatgcagccagcatcgctataacaaattgcagttggcttccaggtaccatgattaacagtccaaacaaaccagaaactccttgagatacagtccctaaatggaataacactgccaaaataccgccaaaacctgaacctaaacaagcggttaggaaaggtttgcccaatggcaaagtgacggcgtacatcatcggttcaccaattcccaagattccgactggaatagaatctcgtgttagttgtttcaactttttattttttgttttcaaaaagagtgctaaaccagccccgacttgtccaccacctgccatcatcaaaataggcaagagataatttataccacctgttggcccagatggatcattcaacaaaacatgtattggagtcaatgcttggtgtagtccaactgataccaatggtaagaagcctgctgacaaaatatacccacctactatacctagcttctcatatacaaaatttaatccactataaatagctgtggttaacacttctccaagaggctgaatgactaacaaagcaaccagaccacccaatattactgtacaaagaggagtcaaaaaagtgtctaaaaaacttggcatatattttcggatatttctttctagaaatgcaaagaaaatcccaacaaatagagccgctaacaaaccgcctgcactaggtgagaatgccttgtccacaaaaggtaataaaattgatttgtcatccactactgtcaacaaaggcattgaaggaactgccacagacatagctccggccattgctcccaaaatcggacttcctttaaattctttcgccgcattcattccaacatagattggcaaaaaagtaaagagtccccaactcatagtcctaatacattgataccaccattccattgcaaaagcattcccggttgatacattaatgacatttgtaatcccatttatcaaacctgccgcaattataccaggtaatataggtataaaaatattagcaattttttgcaagaatcgttgaactggcttgtcgtacttctctttatttatccttttatttgtagcagcaacatccgctgttgtgtaatcttcttcaacacttcccaatgatatacctgtcagttctgaaaatgcttggccaacctttgtcactgttccaggcccaaaaacaatttgaagtgtatctgcctcaacaactcccaaaaccccttctatgtttttgagactatcaaggtgaaccagcttgtcatctcgtaactgtaaacgaagtcgtgtcatacaaactgcattccctaggatattttccctgccaccaacattttcaagaacttgctttgcaacatctttcgtatttttcattttaattctccttatccaaaattgattgaattgcaaatgaaatgtgattatgatagttttccagaagtttttttgcctctatttgatcaagttgactcaactgcatcaagatggctaatttcacgtcttggttggcttgttgaaaaatatgttccgcctccatctctgtacagccagttgtttcacaaataattctttttgctcgttgaatcagtttttgattggtcggttgcacatctaccatgaatcctcgaaaaacttttcctagttgtatcatcgaggtggtagaaatcatattcagaatcattttttgagctgtcccagctttcattcgactagatcccgttacaacctctggtccaaccaatacttcaatcggagcatctaccaatggggagatttccgcatcttgtacacaggaaatactggccgtctttgctccaatttcacgagcatatgtgactgcctcaaggacatatggagtcctgcctgaagcagcaagcccgataaccacatccttcgccgatataccaatttgttgcagatcctctacagctgctgctcggttatcctctgccccctctttggcggcacgtacagctccatttcctccagcaataagtccttgtactaactctggagaaactccaaaagtcggcggacactccgaagcatccaaaactcctagccttcctgaggttcccgctccgacatagatcagtctaccatcctttttcaagcagtcaacgactatttctattactgcattaatttggggcagtatacgttgtacagctaaagcaaccaggccatcttcacgattaatgtaggcggtgatttccccgatagacattgtctcaatagcaaatgagtctggattggactgctctgtattcaatcgttcaatatccatcttattctcctttctttttttgtaaacgtttgctataatcgtattatacaacttttgtattattatttcaatattttttagaaattaaagaaactttataacagactgtgttagaagggaatcattatgaatagaaacattttaaatcactcgatagagaatttaacccctaccgaaaacaaattattggattatattgaagagaacatccatcgtattgaaacaatgaatatctatcaattagccgataacgccggagtatcaacagctacaatcagtcgaatcagtaaaaaaatgggctattctaactttaataagttaaagatagaaatagccaaatcgaaatatgatgatttactcaatgctcacttcacgccatcagattcgattgacgatatttctactaaattaattcattcaataacaatttcaaatcaacaaaccgtcagttttctaaacttggaagaattagaagccgccgtaaaattattacaaagcgcttctcgaatttatttatttggagttggggcatcaggtattgtttgcagtgacttttactacaagctgagtagaataggtaaaacatgtatttttgcacaagatacacatattcagatggctaatattgcaaccgctggaaacggtgacttagcaatcggaattagttatagcggaatgacaaaagaagtcgttgagccacttcgtttcgcaaaagaaaatggagtttcaacgataactatcactggaactggtaagaatcaattagcagatttagccgatattacatttagaatcccacgacatgagcatgaacttcgagtcggggctattacatcacgaagcaactcacttttcctaaccgacttgctttacctagcacttatccaggatcataaacaagagattacagctatcttagaacaaacaaaacatcttacagaagtaatcaaatagaccacctgataaatccactacaaaaagcaaatcccctaagctcgatcgaatcttttattgaagcaactcatacaatagggaaaaaaacaaaaaacacagctcagtatacaagatactggtgctgtgtttttttgtttctatacctgctaattaacgacggagtccgagtgagtgaatcaattcacggtaacggttaacgtctgtgcggcgtaggtatgccaacaagttacgacggcgaccgatttttttcatcaaaccacggtaagttgcgtggtcttttttgtgttgtttgatgtggtcgttaaggtggttgatttcccaagtaagtactgctacttgaacttcaactgaacctgtgtcgccttcatgacgagcatattgtgccatgatttcattttttttctcttttgagattgccatgatatgttctcctttgtttttgagcctaatccgagtgacaggttggcgacctgtaaccaagaaaaagctagatttgtccttttggacctcatttattctatcaaggattgtcttttttgtcaactgatttgaaaactagctgagtagctctgctattttcaaaaaaagccagcttttgctgactttctgcttgtatatcacatttactctgccttttctgcttttggcaagatgagattgaggataatacctacaatggctgagagggctgtacctgaaagggtgatggcaccgatgttgagaactgctccaccaagacccaataccagcattgagcttgcaataatcaggttacggacttgaccgaaatcaacacggctctcaatcaaaactttcaaaccgtttgaggcgataaccccgtaaagcaagatagacatgcctccaagtacggcacttggaatagtagagataagggatgtaaatttacccaagaatgagaaggcaatggcaatcaaggctgcattacggataacggatactgatgcgatgcgagtcataccgataacccctgtattttcaccataagtcgtgttagcaggtccaccgataaaggcagatacggcagtcgccacaccgtcaccaatcaaggtacggctgaggcctggatctttcaagaactggcggccgcagatttggctgagaacggtgtggtcaccgatatgctcagctactgttacaacagcaattggtaagatagcaatcatttctggaccgaagtagaaattgtacgacttgaaggcacctgtttcaaatggtaggtagaaacctggtaattcaaaccaagctgcttccagaacaggtgtgaagtcaaccaaaccaagacagagtgcaatcacgtaaccaccgatgatggcaatcaagaagggaacaatcttggcgaagcctttccctttggtattgacaaaagcagcaatcaagaaggttgcgatcgccacaacgacgtttttccagtcaccgtctgcgacaaagcctgccgaagtcacggcagagttggcaagacccagaccgataacgataatcataggaccgataacaatcggtggcaagagggtatcaatccacttggtcccgataactttgacaagcgcagcaatcaagacgtaaatcaaaccgacaaagagaatacctgtctgcgcagctgacacatcgccgcccatttccttaatggcgagggccatagctgagatgtaggcgaaggaagatcccaggtaaaccggcaccttaaactgtgtcgctacttggtaaatcaaggttccgacacctgatgcgaagagagccacggaaactggcataccgagaatcagtggcaccaagattgtcgctccgaacatagcgaacacgtgctggaaactcaacaaaatcccttgaagcggtgctggtttctcatggacatcaaacaaaagattggcttttgtactcataaatctcccattctgggtacacaaaaagacccagactttctaaatatacatagtcataggcccttaatgaattatcctgttgtctttctcacctcacgggatgagtttaaaaacctacgcttttgatattgtaacataagcccttacttttggcaaggaattttgtaaatttttattttttagaaaaatggctgagcaggagctgaactgcttattattactccatttttccaactctttttccacacgagctaactttaaacgaatatttttcatgccatagccatcctcctgtgcatttttataattttattacacactatattttctattttgaaatatatatcttacatttcgtttaattttttaacagaaaaagaagacaatattgccttcgtaatatacgtacatatttaggtattactctccctactccacactcttaatccgtttcttaatcttctggctaaactcaatcatcctccccttttcctccggccagattttggtcacgcggtcaacagcaattatgaagatgattaccgcagcatagtccttggctttttcaatcagaccaacactttcagcaactactaaaagtagatagaatgtgaataaaatagttcgtttgggtaacgccatcaaaaactcaatccctgccttatagcccagataaatctgccgattaagccctttggccttttccaaacgacgattgagaaaggcacgaatccgcttgtaaaaccaatccgaagttagaaaaagtgattgggcaccaattacaatcaaagaaacattattggcatgttcttccttaagccctagcgctctagtcacaacataggtccaatcaccattatcaatacagataaaaatagtaaagtaaacaaccgctcccgctactataacaaggggaagggcacggatatatttcaacatataataacctctcttggacaattcttagaacctatattcataaacaaagtgttcttatgcaagatatcgtttttgctcatcaaggcaattttttgaaggaatacttgactctatcaccatttagtttcactttattgcttcgacgagtaaaaagctcctgtggctgttttcgcctaccacctaattggtcaggaatctcctttccttatctccaccttcaaacactccaatggaagctatgaactgtgaacacaggttcttgtatatattgtaatatgttatgccaagtacggtcaagtaggggctagaatttcaggtacgacaactgtacacccttagcattttttacttaccccaaaaagaagaagacctccaatcgggagcaagtctcttctatttatctataattccacaccaaagacttctaattgctttaattcggcagcagtcaacctgcggtattctccaagcgctaattttggatctaagcgaagaggccccatggtcaatcgttgcaagtctgtcaccgtctttccacaagcctgcaccatgcgtttgatctggtgaaatttcccttctcggatggtgatgtcaacgagcgaggtctgcttagcttcatctgtagagaggatggtcaactgggctggttgacaggtaaagtctttcagctcaattcctgccgcaaatcgttcgacatcctcttgggtcatgatcccgtcaacctgtgctcggtagagtttatcaacatgctttttcggagaaagcatggcatgagccagctgacccttgttggtcaaaagcaagagaccgtgggtatcgatgtccaagcgtccaacaggaaaaacttccttctggcgagctgtattatctagcaggtccaagacagtccgatggtggtcatcctcggtggctgaaataactcccttaggcttgtttaacagatagtaaacaaaggtttcatgactaaggacctgacctgctactgcaatctggtcttttttttcgttaatttgctgtttgggtgatgtttctacttggccgttgactgtgacttgcttgtttttcaggagtttcttgacttctgtccgactgccaacaccgcaatccactaaaaatttatctaatcgcatacgagtttcttttccattttgatatattctgcttgcttttctatttctgtaaaaccaagagcatgaaagagtttttgggcaacttgatgagagctagcaactgtcagtttgatactagctggctgaacatgctctactaaatagtcttcaatagcctggtagaaagctctgccatttccctgacctgtcaaagaaggtttcatgcccaaacgaatgtcaactgtctcgccatcttggtcaatacagaaatagcccatgagggcagcattgcggatgactgcaaaaaagcggtccccacgcgcctctggtgaaatcatcacagcataaatctcggggtttgcactaatcgtataggcatccaaaggtggttgatagcgccattggttagcaatttccaatgccagatcctggggcaggggcatgatgtaaaaataatccattcttcagaaattttttgctaaatttttaatccgacggttttgggtggcgtaactatctgtctgataaacataatccacatagcccaactgataggagggaatcatgtccttaaaaatcaactgaacatcctctggaaaacggagtattaattcatttaagcggttattttctaacataagaatattataccaaaagaggctgggcaaaaagcccaacggctactacttagagttcgtgtcaacatctcagcgcagtggttgattggcagatttgttcgtgtattacactccaaatctgacctatacgactgatgcgaacagagttcgcttcatctccaacctcaaactgtctcccagacagtttgagctgtgcgggggtgggagtgaaacagtctggggatagactgtttcagctcaacaactggaaataaggacttgttgacgaactctttttagaccagtcgagttctttctcactcccacttcttcagttgtttataaatcaagcctgcgcttatcaaggcacagccgatggcgtaaataccaaaggcacctgttggggttgggttgagtttttccagataagtcggcaagatagcagatgtcgcaccgccgatattgcagcccataaggacgattgtcatgaccgcattgagcaaggccttgggtgcacggtctgttacctgactaaagacaatggttagaatgatgctgtagaaaaatcctgacaccatgccaccgagtcccagcacccagagattatctgcaaaggcaatgccgacaaccgcgagtccaaagaccacgtaggaaacagctaaaagccagcccttcaaacgaccaaccaagctactaaagaccgtccctgccacaatccccatgacctgcataagacttagaatgagactggcttgctgagcagtaccgatgcccttggctaaaacaatctgaggaatacgaatggtcaggaaggtattgacattgataacaaagaaggctaagaatgccagataaatgcccatcatccacatggtcttgtccagtttgaccttgggcgcgttctcctcaacctttacctccatgcgagacagcaattcctccttgggtacgaaaataaggaagagagccaagatgaccaaggcaaaaaggtagaccaagaaggcaggttgccaaccaaactgggtcaaccaaccgacaagtagggtaagccctgcacttcccaaaacctctgctgaaccacgcaagcccatcatctgcacccgctcctgaccggtgaaaaaattaccgatgatattaatagcacgcgcattgattaggccaatccccaaaccaagcaagatgcgagccaataaaatcagaggataagcagttagaaacatgggcaaagctccgccgatggccataagcaaaagccctgcaatgataatgtttcgttcagacaagaaacggacaactagaccgtttgccaatagagtaaccataatagcaaaagaggtcaccgtaattaagttttccacctgggccgctgcaattccctgctgggcaaaatactcaatcatctgtggaatagctggcgagacagcaaatgtcgaaaccagcatggtggatagggccagcaaactggctttttctaaaattcttttcatttttctccctttcaacgttcgtcttttactagtataacagatttgaaagcgaatggatagaaaagtccgacttttattctctcccatttcatgctatacttatcttaactatattcaaaggagagaatcatgtctgttattgaacgattgacaaaagctgcccatttgattgacatggatgacatcatccgtgaagggcatccaaccctacgccaagttgccgaagaagttgcatttccactatctgatcaggaaattattttaggcgaaaaaatgatgcagttcctcaaacattcgcaggatcctgtcatggctgaaaaaatgaaactccgtggcggagttggtctagctgcacctcagattgacgtttccaaacgcatcattgctgtcttagtcccaaacccagaggacgaggaaggaaatccacctgcccaagcctactctctgcaagaagtattgtacaatcctaaaatcgtggcacattctgtccaagaagctgctatggaagggggcgagggctgcctatccgttgaccgcgaagtccaaggctacgtagtccgccatgcgcgcgtgactgttgattacatggacaaaaacggagaaaaacaccgtatcaaactcaaaggctttaatgccatcgtggtccaacacgaaatcgaccacctcaacggtgtcatgttctacgaccgcattgacccagaacacccatttgccgttaaagaaggcatgttggtaattgaataaacataagaaactgactgaaaaattttcggtcagttttttatgtgagtacgaaaaaacgaccctttcggatcgatctcaataatagtcttttagtttacttttagtactaggcaacgagccgcaggcataactggagttaggcaaggtgagttaacgacgtaataaaagataaactaaatgacgatatcttagtaatattccccttgtctgtagtcccaagagttgaaatggtcagacaagtgcatcatgattttatcaatgtccagacccttacggatgacaactggacatgggctgatagaacggctatccgcgctttgttctggaatgagtttaccatctttgtctaccatagacaccataaccccttgctcatagcgggtttcaatggtcttgtctggctggatagatgtcacataatcatccgcctcgataatcaagtccactttagaagcgatacgctcaccgataccttctaccttgccacgatttcccttacctgacgggttagcagatgacgcatagaccatacggccttctttttcccacatttccttagcaatctgctcgcctgctacaccaaacttgataacaaagcaagaagtaccacgaacgtcggtcatcaactcttcacgaccatcgccataagcctgcaacttagcataagcctctggtttccacggcaggatacaacccaacaaaatgtcctcatcccaatgtttttggtagaaggcatcaatctcaggagtcaactgtgccaactcacgaagctcctccatgctaccacaaaggacaacgcctggcttattccgcttgcgctccttagcatcaaacttacgctccaagccagccttgtcagcagtcatgatgatgtaaccaaccttggtcgggcagacaatcacgcctccctcacccttgataatgtcaaaaccttcttgtgaaagtccgccatcccagtgaatttgtttcgtcataataatttcctcttttcttttgttccatagcagagcgatctgcttgttttctaatatttttagttttgccagtagcttgggcgattatcctcatactcagcaatcaaatcctgatactgtaaggtaataccaatatcatccaagccattgagcaacttgtgtttccagtcctgttcgatgtcaaatgggcattccccaaaaggcgtccgtatcaactgatctgccaagtcaaccgtgatttcttggtcaggacccagctgagctagttggtccctgacttctttgggctggataatgggcagaatcccattgttcaagtcattgttgtaatgaatatctccaaaggagcctgcaatgatgaccttgaagccataatctgccagagcccaagcagcgtgttccctagaagaacctgctccgaagttatccccagatatgaggatactagcgccttgatactcaggctgattgagaatgaaatcaggattgtccgtgtagttatcatccaagtaccgccaagcatatagcaaatacttgccaaagccctttttgtcaatcagcttgagaaactgcttgggcaggagctggtcggtatcaatattatcattcatgagtggaacggttgtccctgtccatgtggtaaattggtgcattagactcccgccttgagaatgtctagctgtctggtgtcgacaaaacgtccataaagcgcagctgtggcagccatagcaggactacacaagtgggtcttggccccaaagccctgtcggtcttcaaagtttcgattacttgtagaggcgcagtggacacccgcagggaccttgtctagacctaacttttctgcagcacgcttgacagggcgactgcctggtacgacaatagccgtaacctgctctgctattttccgccccttaacaatcctagctgccagctgcaaatcgctgaggcgagcattagtacaggagcctaggaagacatagccaacgggaatgtccgcagccttttgcccaggagccaagtccatgtaagcatagacccgctcgtcgttgtggtcacggatggatgggaaagtttcgtcaaagctaacccccatagcaggagtggtcccccaagtcaccatgggtgccaagtccgacacatcaaggaccaggtgcttgtcatagacggtgtccgcatccgagtagagctccttccagtctgccaccgccgcatcgaagtccgctggtgcacactcccgacctcgcaggtagtcaaaggtggtctggtctggagccatgatgcccattttggagccgaactcaatggacatattgcagatggtcatccgctcttccatgctgagtcggtcgatgacgggtcctgcgaactcgaccacatgacccaaaccacaatctacgccgtagcgggcaatcagagccaggataaagtccttggcatagacacctctttgcgcctgaccgacaaactctactaggagtcgcttaggtttgacctgccaaatggtctgggtagcgagaacgtgctccacttcagaagtaccaatcccaaaggcaatagccccaaaggctccgtgagtcgctgtatggctatctccgcagacaatgaacttacctggctgggtcctgcctgtttctggtccaaccatgtggacaatcccctgatgttccgaaccatgggctgcgtggggaatgccgaaatcttctatattcttagccaaggcatccatctgagccttggaaatgacatcacggatattgtgaatatcaacggttggcacgttgtggtcaaaagtcgcaaaggtcaagtctgggcgccgaacagatcgccctgtatccctcaatccttgaaaggcctggggactggtcacctcatgaatgtagtgctggtccacatagaggagctggggctgaccttcttgccctgtaatcacatggcgatcccagagcttatcaaaaatagatttgccactcatatttacccacctccaatttgggcaataatggccgctgtcatttctttggtagatgcgctaccacctagatccttggtaaaaatgccctctgcaaagactgcttcaactgcctggcgaatggtctgacctgcttggaccaaatcaaaactttcttccagcatcatggcaacagatagaatcatactgacaggattggcaatgccctgacctgcaatatcaggagccgaaccatggataggttcgtagagactgggacccgccaccgcatgactagcagaaggcagaacccctagcgttcctgttaatacgctggcctcatccgacaaaatatcaccaaagagattttccgtcaccaagacatcaaaccgactaggattggtaatcaaaagcatggctgcgctatccaccaactggtgctccaagaccacatctgggtagtccttcgctacctcatccgccaccttacgccataattttgacgttgctagcacattttgcttatcaatactggtgactttttttcgtcttttttgggctaggtcaaaggcagagcggacaacccgttcgatttcctcagcttgataggtattgctatcgctggcttggtcagttccaaggatatgctctccaaaataaatcccgcctgtcagctcccttaccatgaccaaatccacaccgtccagccggtcgaccttcagaggagaatagtctttcaggctatcaaaaattttcaccggacggatattggcaaagagacctaattccttacgaagttgaagaagaccttgttctggacggacagcggcatcatcatattgagggctaccgatagctgctaacaaaatcgcatccgccttacggcaggcttgtaaggtttccttaggtagagggtgcccgctcgcatcaatcccagcgccaccaaaggctctctcctcaatctcataatcaaatcctacttgcccagccacagcctcgaggactgctaggccagcctccatgatttcaggaccgattccatcaccagccaaggctacaatttttttcgtcatatttcctcctagatgtgtggtaactctttctcagatagtttcttatcaatctgtccgctattttctttctgtaccatgacattggcatgaatataggcaatggcagaagccttcaccacgtcaaagtcaataccagaggcattaaagaccgtttccgttgccttgttttctacggcgacaagcacacgcgcctgggcatcaattccatcggtgatggcgtcaatatggtagcgttccaagctaatctcttggtggaagaattggtcaatagcattaaagacagcctcaacagaacccttgcctgactccgaaacaaccacttcttcctcatcctgattgatgaagatgacctgagcctgaatacttccgtcagactgactatccaaacgcaaatctttaaattggaagccatcacgattgctgatttctgtcccagctactagagctcgaatatcagcgtccgtgattttttccttcttgtctgccaggtttttgaaacgagcaaacaagctagcaacgtctccttcttcaaaatacaggtctagttctttcagcttttctacaaaggcatggcgaccagatagtttacccagtggcagagaatttttcttgacccctaccaactcaggtgtaatgatttcataggtcgatggatttttcaagacaccatcttggtgaattcctgactcgtgagagaaggcattgccaccgacaaccgccttattgcgtggaatggcaatcccagaaaaacgagatactaattccgaagtattgagcgtttcctttagaacaatcggactggtcacatcatagaaatctttccgaatttcaagggcaacagctacttcttcaagggccgcatttcctgctcgctcaccgataccgttgatagttccctcgacacgaccggcaccgtttttaatagctgaaagggtattggcaacagccattcctaggtcattgtggcaatgtggactgaaaataatctcacggtccgatttgacgtttgttgtcaagtaacggaaaatttctccgtagtgctgaggagtcgtaaagccgactgtatctggaatgttgatgtaggtcgcacccgcatctaccgctgtctgcacaacttctagcaaataatccaactccgtccgcgtcgcatcctctggtgagaactccactacctcaaaacgctcacgtgcatagctgacatgttcagtgatttgcgccaaaatttcttctttggtcttttgaagtttaaattcacggtgaatggggctagtcgcaatgaaaacatgaatctgcggatacttggcatctttcagagcctcataacaagcatcaatgtctgattttactgaccgtgccaaacctgtcacagccgtcttggtcatcgctgccgcaatctgacgaaccgcttcaaacgaatcaggactggccgcaggaaaacccgcttcaatagcagaaatcccccatttttccaactgcttggcgatggtcactttttccttgatagaaaaattcacacctggcgtctgttcaccatctcgtaaagtcgtatctaaaaattcaatcacacgcataagaatacctttctaaataaccctaacgtcaatattaggttctctttcttagttttcaaagtatactaagaaaaagaaaacacctcgaggactattacctgcgagatgttgtcaacagcgcccgcttggtaagccaaacaggactaatgctacctagtgcactagcccgaccgtcgcaacaacaaagcaaagaattttgtagtgacaggtttcatttgactttttcctttcagtattttaattatttacaatgataccctacttattttcacttgtcaacagaaaaatggaaattttctgaaaaatccgaacaatgcggcaattcgtacaaatccagataatagaaaaccatgctccaattgaagcacggttcaggtgtttaattccgtctagaactgctaaaaatcgccactaagagaatagcccctagaacagacggcactacagccataccagcaaactgtagtccccaatcaccgaagagcagttgtccaatccacgaaccagcaagtccaaggatgatatttccaagacaaccacgacggtcatctgatgaggtcaaagcccccgcaatcaagccaataatggctccagcgattatacttgataacattctattttcctccttatttacaaaataagactggtctcccagtcttatagcattgtttttagatagcccactcaccgtcacggaagattggcacacgagtaccgtcttcacggattccgtcaatgttcatcttgttagaaccaatcatgaagtccacgtgaacatctgagcggttgagaccagcttctttgagctcttcttggctcatttctgtaccaccttcgatagagaaggcataggcttgaccaatcgccaagtggtttgaggcattttcatcaaagagagtgttgaagaaagttacacctgattgagagattgggctcttatctggtacaagggcaacttcacctagaccgcgtgcaccagcattgtcaaagaccagtttcttcatgacttcgtcgcctttttcagcagtcacatctacaatctcaccatctttaaaggttaccttaataccttcgataatattgccgttatagctaagaggttttgtagaagttacataaccatcggccacacgatagtcaggagctgtaaagacttcttctgttggcatgttggcaataaacttctcaccttgggcattgatcgaaccagccgcttcccataagtggtttttcggcataccaagaacaaggtcggttcctggtgctgtgtagtgcaatttgacaaactgctcgtcgttaagaaccttagcttttgctaccaaacgtgcttcatgctcttcccaggctttgattggatcttcatcgtagatacggcaagtcttgaaaatttggtcccaaagtaagtctactgcttcttcgtcagacgttgcatttgggaaaacttttttggcccattccaaaccagatgctgcaccaagtgtccagctgattttgttagcttgggatgcttgccgcattgggttcaaagcctggctgagtgcacgagcgttgcgagacaatttctctggatccacaccgtcgtaggcccctggatcttctgacaagacaaccaaacggctggccttccgctccaagaggtagttcatttcagtgatgcgttgtgggtgaacttgttccaagagttccacatctacattgaccaaacgctcgcgcgcaatcacatcgtccaaccagttgaccaagacttccttagcaccgtgagcgtaagcttctttgacaatcaagcgtgccaactcagcctgttccacaccaattgtcaattgaaccgtgtgaccaggttggacattgatacctgttgaaaccaagagtttagcatatttagcgagattttctttaaaatttggtaataccatctttttctcctttgtactttgaaataccctattattgtatcatattttaagctagacagataaaaaaacttcctgctgatacaggaagttgaaaaggttagctctgggagatagttgaagcttggagatgaaacgaatggagttcgtgtcaacaagctgcaggcataaccctgctcctctcttgttttaagggaacaggctgaaaaactccactggagctttacactcaccacatcaagtcaacaacgtctgatcccaattttcgcagagtattagttaccaaaaacctttacacggtcagaatccgccatatagtctttgtctgctgctggagctgcaatgcttccgaatggtgcttgggcgcggagtttccagttagctgggataccgtatttttcagcaacttgtgcatcaaccaatgggttgtagtgttgtacgttcataccgatatttttctcagcaaaggccaaccatactgcgtacaagttgataccatgagcttgttcaaaccagattgggaagttttcagcgtaaagtgggaagctttcttgtaagcctttcaccacgtcttggtcttcgaagaacaagatagtaccggcaccagccgcaaaaccagctaagcgaccttttgtagcttcaaaagcttctgcaggcgttactttttccaattcgctgtaggcaatttcgttccagaaaacttctgactccgcaccaaaaagtaccactgcacggctagattgtgagttgaaagctgatggagattctttcatggctttctcaacaagtgctactacttcttcatttgatactggcaagtctttaccaagtgcgtagattgaacggcgagtttcttgaagttttgcaaagtttgacatatgttttcctcttttctatttgttactacatagtagtttttatcactatagggagattgtatcattattactaagtagtgtcaaattcctagtctgacttttttatactccgtgaaaattaagctagttacagcagatagtctgattttcataaagtagtgacagagaatttacaaaaagatggcaaaaaaagcctatcaaatacttaagatacattgatagacccttctttatcttatagccccaacatctcgtctgtaaaatcagtcagcgaatgttccttataaaattccaagtccttcaggcgaatgattttggcaatgacgctaatcggaaactgatgcaacagagtattgaaatactcaacctgctgattgtatgaaatcttccattgtgctaaattattttctgtttcaaaaatttcattcagtaacctttcaatatgtttattggccatcaattccggcatttgacgcaaaaattgaccaaattcttgtgaactttcaatcttggtggatttcataacagttttttcttcaaccgttcgaattttggaaacggatttattgatgtccaaaatggtttctttttcaagattctggtgtttttcaaccaagcggtttgctttcttcatcaaggcctgattgcgctcttcaataacaacgatatgacttttactagctttcgcggcttgttcagcctgacgaagttggttatacttcataatgatatggagaatgaaactcgttagtataccagcaatcacagtaaaacctggaaaaggttcgtaaatacctgatgatgattccggtgtggcaaaagataagatcaatgtccacaagatagtagaaagcagtactagaccaattccttttaataactcaactaaaatatttctttttttcatcatttccttttttaaaacaaatcatcaaagagactcaactggttatcctctggcattttaccgaggatgcccatttcatccattttttcaacaagcgtacctgacaatccaccacgtttacggagttctgtcttggagagaaattctccttcggcacgcgccgccacaacctgcttggcaacgttctctcccagaccatccatagcgacaaatggtgggatgagggtatcttcttcaatcagaaagtcggtcgcatgggatttgtagaggtccaacttaccgaacttgaagccacgttccagcatttcatttaccaattcaagtgtggtatagagatcctgctcaacgttcgaagcttcattgtttttcttcttgagggcgatttcttccatcttagccttgactcgttccaagccaccggacatggttgccaaatcaaatgccttggcccgaatagagaaataagcgcaatagtagtaaagtgggtgatgaaccttgaaataggcaacccgcaaggccatcataacgtaggcagccgcgtgggctttagggaacatgtacttgatttttccacaggattcgatgtaccagtctggcaccttgttatccttcatggcttgaatgtagccatttcgctcttcctcagaaatcttgagccacaagcccttccgcacccgctccatgatattaaaggccatcttaggtggcaaacctgcgtgcatgaggtaaaccatgatgtcatcccgacaaccgataacagtagatagattagcaattcctgccttaatcaagtcctgggcattgcccaaccaaacgtctgtaccgtgcgatagaccagataactgcaagagttccgaaaaagtggtcggtttggtttcctccaccatcccccgtacaaagttggttccaaattcaggaatgcccagcatacctgtcggtgtcccaatctgctctggggtaacacccagaatttccgtaccagaaaaaagagccataacccccttatcatcagcaggaatagtttgcggatcgatgcctgacaagtcctgcaacttccgaaccatggttggatcatcgtgtcccagaatatcgagtttcaagacgttttcatcaatatcgtggaagttaaagtgggtggtctgccagctggctgtcacatcatcggcaggatactgaacaggggtaaagtcatagacatccatgtagtcaggaaatacaataattccccctgggtgctgaccagtcgttcgtttgacaccagctgctccagcagccaggcgttctacttccacatctctatagaatttgccataatcccgctcatagcctcggacaaaaccataggcagtcttggcagctaccgtaccaaccgttcctgcacggaaggcattttcttcaccaaaaatatcccgaacatccaaatgggcagacggttggtcatcccctgagaagttcaagtcaatatcgggaaccttgtctccatcgaaaccaaggaaggtctcgaaaggaatgtcctgtccatcttttttatacttggtcccacacttttcacaatccttgtctggcaggtcaaaacctgaaccataggaaccatctgtgataaattcactgtgttgacaatttggacagacatagtgaggaggcatagggtttacttcggtaatcccaatcatggtcgcaacgaaactggagccgacagacccccgtgaacccaccaggtagccccgctcgttggaacggtgcaccaacatctgcgatgccaggtaaatcacggcgaatccattacctaaaatggaagtcagttccttttcgattcgcaggtcgataatgtctggcaaggggttgccataaatctcaaaggctttctgataggtcaattccgcgaccgtttcctcggccttctcaatataaggcgtataaaggtcggtcttaaccacctgaacatcttcaaaccggtccagcatggcattgggattggtaatgacaatctcacgggccagactttctcccaagaatgcaaactcgtccaacatctcgctggtcgttctaaagtgggcttttggcagtggtgctggctgagcgttttcaccatttccgatggtccagttaatcggtgccccttgacctagagcacgaacaatgatttcccgataaatttcctcttctgggtcaatgtagtggacatttccagtcgccagaacaggcagacctgccctacgtcctacctcaatcaactgcttgatagtctcttcaatctctgccatgtccttaaactgctccttggcaatcatgggagcatagagggcaggtggcataacttcgataaaatcataataggctgccgttttaaccgcttcatctatccctttggagagcaagtcatcgaagacctcaccctcttgacaggctgttcccaatattaaaccttcacgatgggcattgagaacggtccgtggaatacgtgggactccctcaaaatacttggtattggaaagagagaccagtttgaacatatttttcaaaccaacctgattaatcacatagagcgtggcatgcttgacacgagccttcttataggaatcctccgcaatcagctccgtatttagctggttgagattggtcaaattgtgcttctccagagcatcttttaggaagatgaagagcaggcgccctgtcgcctccgcatcgtagttggccatgtggtggtgttcaagagcaacaccaaaccgcttggtgagaggacctaaaccatgacgcttaaagtcggggtaaaggttacgagcaaattccaaggtatcaatgacaggctggctaataataggtaagcctgctcgttcatagttgacattcataaagccaacgtcaaaggtcgcgttgtgggcaaccatgacggaatcttgacagaaatcttgaaactcacgcaggacttgttctagaggtttagaaccacgcacatgctcatctgtgattcctgtcagatctgttgtaaattgactgagcggatgacctggatcgataaactcatcaaattctgcaatgatattgcccttgtgcatcttagacgccgcaatctgaatcagggcattgttgactgcagacagaccggttgtttccacgtcaaagaccacataggtggcatcagacaggactacatctgcttcgttgtaagcaatgggcacagagtcctcgacaatattagcctccatcccgaagaggggcttaatcccagctttacgagcagcatgatagccatgggggaaggactggacattgccgtggtcggtaatggccaccgccttgtgtccccaggctgccgcacgcgccaccaagtcctcaacggcaggcagggcatccatagtggacatgttggtatgggcatgaaactcaacccgcttctcaccctcaggcatgagatctttgcggatttccttcttgacctcttggacttcctgtacgttcatagtcaaatcacgagtgaaattattggtttccacattgcctcgcacccgcagccagtttccctttttgaccatatcaaacttctgagcctcttcctcattcttagcccacttctgcaaggtgaaggacgaagtatagtcggtcatcttaaagttgataatgacccgccccgtcttggtcgtcttctgctcgacctcaaagaccagtccctcaaagacaatccgattctcctcgctatccacctcaatcataggcgtaatctcagccttttcgatattgaccttggcaggacgatttttcttatattctgggacaaatggctgagctgcctctggtggtggcgccatttgagctagttgttcaagggccgccaagttttcttcattagcctgctggtaaatttctgcattttgcgcatggaaaatctccgcttgttgctgcgtcatttcctgacagacttggatgtccaccgcaagattaccaaaaccaaatcgcttgtattgctccacaagatttggcagatgattcttccgaaaatgatctgtgtcaatggtttcaggaccttttatccacaaaacaccatctctataagccacctctaatggctgaaaaagggccttgaagcctgcactctggcacaaatcttccgtaaaagcttctggataatatgcttctaccaaaccagcttcaaaagcctccgcatcgctgacaatagaaaattgaatcttattgcccaccttttcaaactccgtcgccaaacgagccttgaagagttgatagtccatgagcggcaagggggtttcaaaacggaaggtaaattcccaaagtttgctaaccttgtgcaagactactttctcaatcgttgcagtcgaaaaagcccctgattgtcgtgcatcaagaggcattccgatttgttgtagcaagagttgaaacttatctgacatacttatttcctttgtagttcgttagaaacattttaccataaatgaggtattttttcctgagtcaggaagaaaaaactctcaggttcatttcctgagagatctgatttctatagaaattggtagcctaccaagccgcagcttctgtcggtgcttctaaaaagtccagccattttcgatccttgacacgacagagggtgacagaaattcctcccatatcaagactggtcataaatttacctgtttttacataggaaagctgtaaaccttctagctctagaaattggcaaatgtcgttcaaaaagattccttgctcaacctcggacatagatccaagattattgaccagaagaatatagtcttccccttccttccagcggaattttaattttaatttgttcacaatttcgttggctaactgctcagaggattcaaaacgaacggtccgatagccttcttctccatggataccgataccgtaagatatttgtccctcctccaaatcaaacaaaggcagggcagcattgggcaaataggccgacttggttgcaaaaccgatggtcgcaatctctgttgccagagacagtcccagctgttccaattcatctaggctatagccagtaagggcagcagctcctaatatcttatgaagtagaatggtccctgcaagccccctatgccgcatacggaaattattcttagtatcgaccgaaatatcatcatgggatacaatgtacttgactgcaattccctcctgccgagccaattcgatggcttttctaaaagagataaggtctgcctcaaagttttttacaatcagaaaaactcccttgcccttatctactgcgcgaatggctgcaaatacttcttcagcggttgggggcgtaaatatttcaccatatactgcagcagtcagcataccctttccgacaaatccaatatgtgccggttcgtgccccgatccaccacctgaaataattggaactaaatggtcatcctgcactttctgaagcacaatcggaagtcccttcactttcttcactttaggattagttcgacagaaaccatccaaataatcttcaataattgttgcctgtctatttctaataaacaccatatattaactcctacaaaatcacaaacgactcgcgaacaagagccaccatttgcttccaataactgtgaatctgacaaggtgactgtgtcagtccttcctttatcagtccaatccaagcattagcatgatagagaatcaaaaaatgcttatcctgttgggaaatcattttaccctcctggagctggtactcgttgataattttctccatcaaaaccataaagtagccttctaaatagctgacaaaatcattttgccccttaatctcaaagagttgcctatagaaagattggttactctcgatgtagtacaacagctcatccagaagcttgattccactaatataggtcagattgtcagttacctgctcctgcaattctgtctcaaatatccagtccagcaactcatacttgtctaaaaaatggttgtaaaaggtttgacgacgaatccctgcttcctgcatgatgtcgacaactgagattttatcaaaggatttttgggatagctgttttttaaaagcctttgcaatccttttctttgtaatcaacgaggttggcatatgtcacttgtcacttcctttcgcttcctctttattataccctatcatgcttttctttggaacaaaagggacactttggacaatctgtcccttccttttttcttttggacaatgtaaaatgaaagcgcaaacaataacaaaggagttttctcatgaaaaaaattatcaatcaacccgaacatgtcgttgatgaaatgttaaaaggacttgtctttatgcaccaagatcttgtcgatcgtatcgatggatttgatgtgattatccgcaaggctgaaaaaactggtaaagtcggcatcatctcaggaggtggctctggtcacgaaccttctcatgcaggctttgtcggcaagggcatgttgtccgccgctgtatgtggcgcagtatttacctcaccaacaccagaccaaatcttagaagccatcaaggctgctgacgagggagctggcgtctttatggtcatcaaaaactactccggcgacatcatgaactttgagatggcacaagaattggcggaaatggagggcatcgaagtggccagtgtcatcgtggacgatgacatcgctgtggaaaatagtctctatacccaaggccgtcgtggtgtagctggtaccatccttgtccacaagattctcggtcacgctgcaacaactggcaaatctctagcagaaatcaaggaactggctgaccgtctcgtcccacaaatcaagactatcggcttagccctatcaggtgctacggtaccagaagtgggcaaaccaggcttcgtccttgaagaggatgaatttgaatacggtgtcggtatccatggtgaacctggctataagaaagaaaaactccaaccatctgctaaattggctgaagaattggttgagaaattggcagaaggctttgatattcaagatggcgaacactatggtgtccttatcaacggtctcggcgcaactcctctcatggaacaatatgtctttgccaacgacgttgctcaattgctggctaaaaaaggtgtggtcgttgactacaagaaaatcggtaactacatgacatcgattgatatggctggactgtcattgaccttaatcaaactagaagacccaagctggattgacgctttgcaggcccctgttgaagtggtagcttggtaggagaaagactatggatgcaaaacaagcattgctctggatggaaacattcaacaaaaaaattcaagaaaacaaagattatttgagtgagctagattctccaatcggagatggagatcacggaggcaacatggcgcgaggaatggctgccgtcatgcaggagctatctgaaaaagactatgagactgctgaccaagtctttaaggtggttgccatgcaacttctcagcaaggttggcggtgcttccggtcctctctacggctctgcctttatgggtattactaaagccagtcaagctggcgctgatttggcagatacgcttcaagcaggtttggacatgatccaaaaacgcggcaaggctgaattgggcgagaaaaccatggtagacgtgtggattcctgttatttctgccctaagagaaagccagctgacaacggaaattatccataaagccgttcaagggacaaaggatattgctgcgaccaagggacgcgcgtcctatgttggggaaaggtctattggacacattgatccaggctctttctcatctggacttctctttgaagccatgttggaggcaggactatgacaaaggttggtatcttactcgtatcccattcaaaaaatttggcccagggaatcatcgacctagtatctgaagtcgcaaaagatattcccatcacctactgtggcggactagaagatggtagcatcggtaccagctttgaaatcgtacaagagcgagttgaagcaaaccctgctgataccctccttgcctttttcgacctaggtagcgcccgaatgaacatggaacttgctgccgattttacagacaaacaaattcttatccaaaccgtaccagtcgtcgaaggttgctatactgccgcagctctcttacaggctggagctgacttggagactattcttgaacaattaaaagaactgacaatcaataaataggaggtcattatgaatctgattggagaattacttggaactttcatactagtattacttggaaacggtgtggttgcatcctgcatcctctctaaaaccaaggctgaaaatagcggctggctgaccatcgtactaggatggggcatcgctgtaacaattgccgtctacatatcaggaatttttggacctgcccacctaaatccagctgtcactatcgcaatggcatctatcggctccctaccatgggctcaagtcccaggcttcctacttgcccaatttgctggagcaatgttggcatccatcgtcctctatctccatttctacccacattggcaggaaacaaaagatagcggaacaatccttgctaccttctctactgcaccagctcttcgtcacacagcttcaaacttgctcggcgaagctcttggtacagctgtcttagtcatgggaatccttgcaattggtcctaacaatgtcagcgctggcctcggcccaatcatcgtgggacttatcgtatttgcaatcggcttctcactaggatcaacgacaggctacgcagtcaatcctgctcgtgatttaggccctcgtatcatgcatgccatcctacccattccaaataagggagattctgactggtcttatagctggatcccagttgctggcccaattcttggaggtgtcgcaggagctatcctctataacatcctactaaatatgttatagtcatttgaattaactttgatacatcgtcactttcggcttgccgtactatagtacagcctgcacctcagttccttgtctgaaagctaattcattcgactatataaaaaataggcttgggtgactagaaccactcccattttatcaacaaagacttggctatcatcaaccaagtctttttctgttattcattttcttttgtaaggatttgcaaggtttcaaggagttggtccacatggacttctacagtatcacctgtacccttgattttcacttcgacgatgccatcagctgctttcttaccaacagtcacacggattggcaagccaatcaagtcactgtcagaaaacttaacgccgacacgctcattacggtcgtcagttaatacttcatagcctgcaccaaccaaacttgcttcgatagactgagtcaattccatcgccgcttcatctttgacattgactggaatcaaatgcacatcaaacggtgccaattctttagggaagttgatcccccaagcgtaacggtattcgccttttggtgtcttgttaacaaagaggcgagcgtgttgttcaagaacggctgacaagagacggctaacaccgattccgtagcatcccatgataatcggcatagaacgaccattctcatccaagatgttggcattcatgctgtctgaatagcgtgtaccgagtttgaagatgtgaccaatctcgataccacgggcaaagttgagaaccccgtgtccatctggagaaggctcgccttccttgacttcgcgaatatccacatactcagtcacttggaaatcacgccctgcattggcacctgtgtagtggaaaccatcttcgttagcaccaactacagcgttcttcacatcttgaaccttacggtctgcaataatcttaatgttttctggtaaaccaactgggccaagagaaccaaagcctgcaccgaagactttctctgcatcagctgggcttgctacatcaaagaaatccgctgccaagtggtttttcaacttgacatcattgacctgatcattgccaacaaggagggcaacaactggctctccgtcagccataaagagcatggttttgatagtttgttcttccgcaacgttcaagaaggcagcaacttcgtcgatggttttggcatctggtgtagcaactttaaccaagtcttcttcaactacaactgctgtacttggtttgtattcgctagttgccatttctaggttggcagcgtagcctgattcgcttgagtaggcaatggtgtcttcaccagacacagaccaagccaagagttctgccttgaacgcttcaagaacatcctctgggatttcctcaaaagaagcaaccgacttgtccaagacaacccaacggtcgagatcggtacggtctggtgtaatagccataaactcctggctatccttaccacccatggcaccaccgtcaccgataatagccttgaactccaatcctgcacgagtgaagatcgcctcgtaagccgccttgtagtcatcgtaggtctggtccaagctctcataactagcatggaagctgtagccgtctttcatgataaactcacgaccacggagaagaccgttacgaggacgtttttcatcacggtattttggctggatttggtagatgttaagcggcaactgcttgtaagactggaccgcatcacgcgccaatagcgtcaccgtttcttcgtgggttggacccaagataaagtcagaaccttcacggtttttgagcttgtagaggtcgtcaccgtaggtttcataacgacctgactcacgccaaatatccgcggacaagagggctggtgccaaaaattcaatggcatcaatcttatcaaactcctcacgcatgatattttttgctttttcaatcacacggttagccaaaggcaagtagctgtaaataccagcagaaatctgacggacatagcccgcacgtaacatcaaagcgtggctaattaccgacgcatccgaaggcatctcccgcaaagtagggataatcattttagactgtttcatagttaagatataagtgcgttaagaaaacgaaacgaaaataggaaacctaacgcagtgcctttggcactaggcaggtttatctttttcgtaaagtttttagcacgcattcaattcctttcatcttttgtttatcaggaatgcacaggtttcagcccgtgttcagttcctttcttagttttcagaatatcctgcgttcagcacgcattcaattcctttcgtatttttcagaatatcctgcgtttagcacgcattcaattcctttcataaatttcaaattatcttagaagaagactcttataatatcattccaagtgactactatcataagaaccaccataacggctacacctgctagagtgatataagattccgtctctggtttgagtggttttctgcgaatggcttccagaatattcataacaatcttaccaccatccaaggctggaattggaatcaaattgaagattccaaggttaatggagagcgcagccattagccccaatacagaaaccaaaccaaattcagctgcttgagaacttactttataaatagcaaccggtccccccaactgcttaacatcaaagtttgcaattagattcttcaaagctgttacaaccctaagagctgtcgctcccgcttcttggaaaccaccgacaattttatcaacgaaaccagttttcaaaatcggtgaaataccaattcgataggccccatctacttgttcagcagtaacggagacatgacggtttttcccatcatgctcaacgaccaaatcaaagcttggggctgttgttgcatctgttgctgctttactaataatcgttgcaacttctgtgtagctgtctgtcgtgttcccattgaccgaaagaatcttgtcccctgtgacaacacctgcagcctgcaaagcaccaccttcagtaatacttactgcattgcttgatgggttggcaacccctccttgcatgaagaacaaaagaataaatactagaatccctaaaataaagttattcatgggacccgcaaagttggtcatcaaccgtccccagactgtcgcattttgatattgaacatcaagtggagcaatccgaacttctgttccatcttcctctacaatcgtggcatcgtgatcaaccttataggtcttgctttcttccaagaccaagcctgtgatttccaatttttcctcgaagtcaaaactggttacattcattggcaaactgagactatccagttgcttaccagacaaattaatccgcgtcacaacaccagcttcattcaggctgaggctggcaggactacctgtcttaatctctgtcttatcttcaccccatccagccattcgaacatagccacctaggggaaggatacggatggtgtaaagtgtcccatccttacctgtatgagcgaaaattttgggacccatcccaatcgcaaattccctcacaaggataccagctttcttggcgaagtagaaatgaccaaattcatggacaaccacaatcacaccaaatataaatataaatgctaaaattcccttcatagtacctccttaaaataatccaaagaagtgcatgattggaaagacaaaaatcataccgtcaaaacgatccaggataccaccgtgtcctggaataatttttccagaatccttcacaccaaaatggcgtttaatagcactttctactaagtctccgaattgtgagaatatcgagaaaatcacaaccaacaacaacatcatgccaaatgaatagcccgctaacaaggacttatcgacaatcaagaaaatgatagcaactaccaccgcagaaagaataccgcctacaaagccttcaaccgttttattcggtgaaaccttcggcaataattttctccgaccaatctgacgaccgattaagtaggcaccaatgtctgttgcccagactagacagagggcaaagaagactttattgagcccatccatacgagccagtatcaaactatgaaagccgataccaacatagaaacttgatgcaattggaaagacaacatcggaatagttgtaatgaccgatattaaaaaccgtcgaaccaagcagtaaaaatactacaatggcgtaggctgtgtaatttccatccgtcggtaaaaatgtcaaataattctggagcggaagagccaagactaaactggccaacatagctaagacaccctcgatagaatttggtgctaggcgatacattttaatcaattcagccgtagcaataatagctaacaggcctacaaaaaattgaaatgccatcccaccagccaacaaaaagggaatgaaaatagctagagcaatgccgccaaatatcactcgtttctgtaaatcgtttgtcataccttctccttatacaccgccaaaacgtctgtggcgacggttgtattctttaatcgctaatttaagtgcttctccatcaaaatcaggccaagcaatatctgtaaagtacagctcgctgtaggctgtttgccacggcaggaagttgctaagacgaagttcaccacttgtacggataactagatcgggatcgcgtaacgttggtgataaggttcctgtatagaggtaatccgctattaatttctcatcaatatctccaggattgaacttggcatccaagacatcttgcgcaatagccttgactgcgcgagtcacctcatcacgaccgccatagttaagagcgaaattgagaatcaaaccagtgttaccctttgtcttttgttcggctttataaagcgcattgagagtcgggacaggaagttttgaatggtcaccaatcatctgaattttgacattattggcatggagttcaggaacatacttatcataaaactccacaggtagattcatgataaacttcacttctttttccggtcgagaccagttttctgtagaaaaggcatagacagttaacacctttactcccaaatcagaagccgtcttggtaaccttttgcagtgcatccataccagccttatgccccataatacgtggctgcatccgctttttagcccaacggccattgccatccataatcacagcgatatgcttagggacttcaattgctgtttcaatgctttctttctttttaaaattaaatttaaacatggtattttccttattgtataatcgtttcattataccatatttttacctaggatagcaaaaatcaggcagggctaaaacaagagaaaaccaaggtttccctcggtttctcatccttattcttcaattgcagattctggagttgcttctggcgtttcaactgccacttcttcaacaactgccgatgtagcatctgaacttgctacacgatcacgaatagcaccacgttcaaatgtcaagtaaacaccatcaacatcgagaacaaccttcttatcatcgatttcatcgacaataccaaatagcccaccaatggtcacaatttcatcaccttttttgatttgatttagtgcttcttgacgttgtttttgttgtttacgttgcgaatagaacataaaaccaatcatggcaaccatgacaagtggcaaaaataaaccttccatttgtttacctcttttattgtttgataagcatgattatatcaaattctggacaagaaagcaaagttcgaccaaacagaaaaagaccgaactttcgttcagtcttcgcacactattttgcgctccatacactctcaaggatgttggtctgttcacgaccaggtcctactgagaaggttgagatacgaacgcctaccaattcgctgatacgacgaacatagttgcgagccgcttctggcaattcatccaggctacgtacacctgtgatgtcttcagaccaacctggcatttcttcgtagattggtttgcaacgtttgagttgctccaaacttgctgggtagtggtcaatacgctcaccatccaagtcataagccacgcagattttcaaggtcccaagacctgacaagacgtcaatcgagttgagggacaagttggtaatacctgacacacggcggctatggcgcatcaccactgagtcaaaccaaccgacacggcgtggacggccagttgtcgtaccgtactctttaccgatttcgcggatacggtctccgatttcatcgtgcaattcagtcggaaatggtccgtcaccaacacggctagtgtaggccttacatacaccaacaaccttgtcaatcttgcttgggccgacaccgctaccgatcgtcacaccaccagcaactgggtttgaagaagtaacgaatggataggtaccttggtcaatatccaacataactccttgcgcaccttcaaacaagacacgcttgccttggtcgagggcatcgttcaaaataacagatgtgtctgttacatactttttgatttcttgaccgtaagcatagtattcttcaaagatttcgtcaaactcaatcggagttgactcatacatcttctcaaacaagcggtttttctcagccaagtttgttctcaaacgctccgcaaaaatctccttgtccaagaggtctgcaatacggataccaacacgcgcagccttgtccatgtaggctggaccgatacccttgttggttgtaccaatcttattctcacctttagactcttcttgcaactggtccaatttgatgtgataaggcaagatgacatgtgcgcggtctgaaatccgcaaattatctgttgtcacacctgaatcatggagatagttgatttccttcaccaaagattttggattgacaaccacaccattaccgattacagaaatcttttctgggaagaagattcctgacggaatcaagtgcaatttatacttcgtgccatcgataacgatagtgtgtccagcgttatcaccaccttgataacgtgcgattacttcagcattagcagacaagaagtctgtaattttacccttaccttcgtcgccccactgggttcctacaacaactactgatgtcatattcactctttctctgaactggctaaccagcccagcctttcttctacttctggcaggaatctcacctgcaagtttcgttttacacactattctatcaaaaaacgaacattttttcaagaaattccaataatttcatatatatcgaatgtttttatttttttaaaagtatattttaaaaaaatccgattaaacacacgaggtagacatgtgtaaatatgcttttggcagagaaatccgaagtctttgtttactttcagtgattttcagtacatttttcaccagaaacgtagcagaaatttgtatttgctctccaatctagataaaattggaataagactttgacagaaatataaaggacttagatatgttacaaaaattatcaccaaacagccccattcttcaggctacttttggaattgagcgcgaatcacttcgcatcaattcaaaccacagagttgcacaaactccccatcctcataaactgggttctcgtagcttccacccctatatccagacagactacagcgagccacagttagagttgattacaccaatcgctcagtcgactaaggaagcgcgtcgcctactgggagccattacagatgttgccgcacgttctatggataagcaagaatacctctggcccctatccatgccacctgtgatttcagaagaggaaatccaaattgctcaactagacagcgactatgagtaccaatatcgtgtcggtttgggggaacgctatggcaagctcgtccagtctatgtctggcatccattataattttgaattaggaaaagacttaacccaacaactttttgaattaagcgaggaaacagattttatcgcattcaaaaataccctctacctcaaattagcacaaaacttcctcaactatcgttggctcttaacctacctatatggagcaagtagcctagccgaaaaaggattcctaaccacggaagtcggttgcgtccgttccattcgtaattccaagtacggctatgtcaactccgatgatgttcatatttccttttcttctctccaacagtacgtggccgacatcgaacaagctgtccaatctggtcaactatccgctgagaaggaattttactcttctgtccgactacgtggagcaaagactagccgtgactacctcagcaaggggatttcttatttagaattccgttccttcgacctgaacccctatgacccgcttgctattagtcaagaaacccttgatacagtccacctctttatcttatctcttctttggttagaccaactgacagatgttgataacaccttagcaaaagcagataaacttaacaatctcatcgccctcagtcacccacacacacctctacctaacgatgccgatgccacgccaatcttgacggccatgaaagccatagttctacactttggactggatgactactatggccaactcattgcacatgcggaggcagcacttcaagaccctcgtttgaccctttccggaaaaatagcagagcaagttgaagatgggtctctagagaagttcggtcagcagcagggacaagtctttcatgactatgcttggacagccccttacgccctcaagggctatgaaaacatggaactctccacccagatgattctctttgacgccattcagttgggcttgaatgtggagattttagatgaagaagaccagtttctcaaactctggcatggtaaccatgtcgagtacatcaaaaatggcaacatgacttcgaaggacaattacgtcattcctctagccatggccaacaaggtcgtgaccaagaagattttggaccaggctggttttccagtacctgcgggagctgaatttgcaaacaagacagatgccctgcggtattacggacaggtagccagctctgctattgttatcaaaccaaaatctaccaacttcggccttggcatctctatcttccaggagccagccagccttgcggactatgaaaaagccctggacatcgccttttcggaagatagccatgtgcttgtggaggaattcgtggcgggaaccgagtaccgtttcttcatccttgatggcaagtgcgaggctgtcctgctccgcgtcgcagccaatgtcgtgggggacggtagctcaaccatccgtgaattagtagagcaaaaaaaccaagatccactgcgagggcgtgaccaccgttcaccgctggagatcattaacttgggcgacatcgaactgcttatgttagaacagcagggctacacacccgatacagttttgccagagggcattcaagcctttctgcgtggcaattccaatatctcaacgggtggtgactccatcgatatgaccgaccagatggacgagtcctacaagcaactggccgccgatatggcaactgctatgggagcttgggcctgcggtgtggacttgattatccccgaccgcaccaagccagcaagcaagaacaagcccaactgcacctgcatcgaactcaactttaaccctgccatgtacctgcacacctatacttacgcaggacctggtcagagcattacgccgaagattttgaaaaaattatttccagagctatagttttccattttccttactttgttagtgcttacttcaaaggttcgtggaacttttgaaggctggggatagggcaaagcacgttcgcctcaatagctgcaggttgctgggagtgagaaagaactcgaccaagataaaaagagttcgtcaacaagttttcgttttaagttgttgagctgaaacagtctatccccagactgtttcactcccacccccgcacagctcaaactgtctgggagacagtttgaggttggagataaggcgaactctgttcgcatcagtcgtagaggccagatttggagtgtgaaactcgaattgctgagatttgcttcgcaaatcctatctccaacctttaacagtccactggactgttaaacccaatcaaccactgcgctgagatgttgacacgaactctgagtagtggtcctgggctttttgcccagcctcagttggaaataagacttgcctctctataaagtacggcaaagcgagttcaaacaaaccagtggattgtttgaagcgggaaatccagaaacggagttcctcttgcgccgaagtaaaaaaagtcaacaaaaggactatatatctgctttgcccttttgttccttcacaaaaactcccaactaatgttaaacaaaatgaatatggcaccaagaaaatcatttatatctcggtgctttttttgtgaaccaattcccatcacccaaccgatttgttcgttttttgtttcgttttccaatttatttttaccatttcatttgaatttttaaaaatatccgtattatatctaaaaaagtattccaaacgactcattttctgttaaactatatgtatataacaactgcagacgtttttatgacgtccatatataacaaaaaggagttttatatgaagattagaaaccgttctctcttctataccgtaggttctgtagcggtaacagccggactcttgcttagtcttgctacttcgcccataccatctgtgcacgctactgaagtggcgatagagaattatccgtcacttgcaataaccaagtcggaagtcacgatacaaggctatcttattgcaccacttaatagtagcggaactgcttttgacgccactaacaaaacaaatctagcccttggtgcaagcatggatactgcggcagccgacactatccctattcaactaaaagaacctcttcgtagccaattcaacctcgttaatcatcccgaactagtcggaaaattggttcgcatcacaggaactagcgatacatacatgaagcgagctgggatcaaaccagctacagcgattgaaatcgtagattcatcttctactaatgttcagccaccaacaagtgaaaatacagctaccaaaccaagtgaccttgtttctacaccgattgctactgttcgttccggagcacaaggaacagagtacacagtttctggtaaaattattagcctagtaaacggttggggaggaaatggtttttacctccagggttctgacggtgctggtatctatatctacccaggggctgccttgggctatcagcttggtgatacagtccaattaacaggaacattgggtgagtataaaggcgaactccaactaaccacagttagcaaccacaaggctatctctgagaatttcaacactcctattacagaaacaaacatcgctcagttagcaacgcaagcacaggcaacactagtttctctaaaaaacttgactgtcggagatattcaaagcgatagctatcaaaattctacctttaccgtaactgactccgaaggacaaactgttgatgtacgcttagatagccgaacaggcatcaaaacggcggatcttttgaaccggatcaacaagggagataagattaatctaaccgctattttatccacctataacggaaaaatacaattaaaaccatttgacctctctcattttgaagtcattgaaaaggcaacgacggaagcaggactaggaaagaccgaagctgtaacagtcggtcgcattcaaggtgcaagtcaccagtcacctctggtgaatcaatctgttatgcttaaaaatgtcgtagtaacctacgttacctctgccaataacttctacgtgcaagatgtcacaccagatggagacaccaaaacatctgacggcattaacatctttactgacaaattaaaaacaaatgtcaaggtaggagatcttgtcactatcgcaggacgagtagaagaataccagggcagagggtatgctgaacgtgacaaaacagacttaaccatcacacaaattcgagctactgaagtaactgtggatgggactgcacctgtaccatctcctatagtcctcggtcttgatcggactatcccagcagatattattgacaacgacggtttggctcaatttgatccagaacaagatgcgctcgatttctgggaatccgttgaaggcatggtggttgccgtggatgatgcaaaaatccttggcccactaaaaaacaaggaaatctatgtcactcctgccactagtcaacttcctttaaataatgttggaggcgtcaaccttcgccctgaagggaataataccaatatcattccacttcttttgaaaaatggaaaacaaatcgtcaaatcaggagactatttcatcggtcgtatcgctggaccagtcacctactcttacaccaattataaagtctatgtagatgatagcacccttccaacattgcacgaaggagctacaaaaccagaaacaacaaccattatcccaaatgatgacaagctgactatcgcttcttataacattgaaaacttctctgctaatagtaagtcaacatcagacgctaaagtccaacgcattgccaaatcctttgtttcagacctacattctccagatgttatcggattgattgaagtgcaggacaacaacggtgctacaaacgacggcacaactgatgctagtaagagtgctgaacgcctgattgcagccattcaagcagccggcggaccaacctatacctatgtagacattgctcctgaaaacaacaaagacggcggacaagagggaggcaatattcgcgtcggcttcctctacaactcaaaacgtgtcagcctatctgacaaaccaatcggtaccgcaacacaggcagttgcatgggaaaacggcgaactcaatctcagcctaggccgaatcgacccaaccaaccctgcttgggcagctgtccgcaaaacacttgcagctgaattcgtcttcaaaggcgagaaagtcgttgtccttgccaaccatctcaactcaaaacgcggtgacaatggtctctacggaaaaatccaacctgtcagcttcaagtccgaagaaaaacgccacatactagcacaaactatcgctgactttacaaaagcaggcttagctcaaaatccaaatgctaatatcgttatgctaggcgacttcaatgactatgaatttactaaaaccatagaaattttagaagcaggaggaatggctaacctcgttagtcgtcacgatgcatccgatcgcttctcttacttctataacggaaataatcagtctcttgacaatatgctagtatcaactaacttgttggagcgctatgcctttgatatggtccatgtcaattcagcctttatggaagaacatggcagagcttctgaccacgatccactattggtacaactggatgtgacaaaggcacaagaaccaactcaaccagaaccaagcgacaagcagacagatgactcaggaacagtcaataatagtgatgacaatggtacgaccaacaataacaagccaacaaatctttcaacttctaatcaaacagctgtaaatgctgatgaccgttctggcgctacagacaagagacaaacaaccgtgacccctactgccaacaacagtcaaaagaaaatccttccaaagacaggaggagaaacaagctttgtacttatcacaatcggtctcgtattcttgagcgcctgtcttgtcaaaaaacaaaaagaatcctaatcattttttgagcttgaaagcatgactttcaggctcatttttctactgctccacctccacttgtgctataattaaagttatggataaaattattaaaacactatcaaaaagtgggcatttccgtgcatttgtgctagatagcacagaaaccgtgaaaacagcccaagaaaaacacgacaccatggcgtcgtccaccgttgctctaggtcgcaccctcattgccaatcagattttggctgtcaatgaaaaaggcgacaccaaaatcaccctgaaaatcttggccagcggtgctgttggggctatcatctccgttgccaataccaaaggtcaggtcaagggctacattcaaaatcctgacttggactacaaacggacagcgactggcgaagtcatcgttgggccccttgtagggaacggacaattcctggttatcacagactacggaacaggtcatccttacaactccatgacacccttgatttctggtgaaatcggtgaggactttgcttatttcctgacagacagccaacagacaccatctgcggtgggactgaacgtgttgttggacgaagaagacaaggtcaaggtagctggcggcttcttgctccaagttttacctggagcgaccgaggttgaaattgcccgtttcgagaaacgcatccaagaaatgcctgccatttcaagcttgctggcttctgaaaaccacatagaagctctgctatccgccatttatggcgacgacgacttcaaacgcctgtcagaagaggaaatcggctttgtctgcgactgctctaaagaccgcttcctcgatgctctagccagcctaccaaaagcggacctgcaagagatgaaagaagaagacaagggcgtggacatcacctgtcaattctgccagacccattaccactttgacgaaaacgatttggaggaactcatcaatggctaatctcaatacccctttcatgattggtgatgtggaaatccccaatcgctgcgtgctggccccaatggccggcgtgaccaactcggccttccgcaccattgccaaggaaatgggagcgggactggtcgttatggaaatgatttctgaaaaaggccttctctacaacaacgagaaaaccctccacatgctccatatcgacgacaacgaataccctatgtctatccagcttttcggcggcgacgccgaaggactgaaacgggctgccgacttcatccagaagaacaccaaggctaatatcgtagatatcaacatgggttgccctgtcaacaaggttattaaaaacgaagctggtgccaagtggctcaaggatcccgacaagatctaccacatcatcaaggaagtaacctcggtcctcgatattcccctgaccgttaagatgcggaccggttggaacaataccgacctggcggtcgaaaatgccctggccgcagaaagtggcggtgtagctgccctggccatgcacggacggacccgcgagcagatgtacacaggaacagttgacctagagaccttgaccaaggtagctggcagcctgaccaagattcccttcatcgcaaacggcgacatccgcaatgtagaagatgcccgccagcgaatcgaggaagtcggtgccgacgctgtcatggtcggacggactgctatgggaaatccatacatcttcaaccaaatcaatcactatcttgaaacaggagaagtcctacccgacctctcctttgacgacaaactcaatgtcgccttcgaccacctgacccgattgaccaatcttaagggtgagtccattgccgtacgtgaattccgtggtcttgcccctcactacctccgtggttcagcaggcgctgccaaaatccgtggtgctgttgcccgagcagagactatcgagcaggtccaagaactctttgaccaagcacgagaagcctatcaggaacggattgctaaataatatagtcgaatgaattaactttgatacatcgtcactttcggcttgccgtactctagtacagcctgcacctcagttccttgtctgaaagctaattcattcgactatatcaaaacctccagtttgagctggaggtttctttatctttttatgaactttcttttaagcgataggtctttctgggtttgcgtttgggcaatcgttccactccaacttcttccacaaagtctccatacttggctaggaaattattgtggaggatttttttgtcgggtgagataagattgaccaagtctgtcgcagcgtagatgttaaagggctgctgcaggagattgagaaaggttggattccacttcatccgtccctgaatccgctggatagaggtcatgacaatctcgtaatggtcaaaggcaaaatcctctgccgtcaagacctgaccctcataagaacactgcgaagtcttgaaatccacatcgataacaatcggctcccgtccatctggacctggtttgaccaaatccaaggcctgactaggcaggtaaaccaagtgggcaatagtcatcatccagccccgcggatcccgctcagaatcggaaaccgttaggagttgctcgatatgattgcggggcaaatccagtcccgcttctttttttatctcacgctgacaggtctggtaggcatcctcacctctggcaataaagccaccgaccaaggacagcttgtgttgacaagggtgggcagcacgacgaatcagcaagagcttgattctcccctctacaaaactatagaccaccatatcagctgtcacgcttggtttttcaaatcgcggagcgtcctgctttttataccagtctaaaaattctgcctctgtcacatatttttcgtagtattccttgtctgatagaccagcaggcctagccatttcgagccacctgcccttcttttatggacttagaccattggtaccagccgacaagcgagttgatagtccaaacgaagtacataaccgacatttgcaggttaccactatctggaccaacccaccacaagtaaatggagaagacattggttgcaatccagaaaatccattgctcacggtagaggtaactttgcaggaattgtcctgtccagttggtgccatctgtaatagagtcacggaagggacgagctgatccaattgacttgtaaatcaagccaaaacttccccataccaagacagcgaagactaaccacttaacccagccccagagagtcagcttacgggcttcaaattctgttttctcttcttctgctgctccattgacacgggctgatagccagaaatacaagccaactggctgcatgacaatgaagaaaatcgctgtcatgacttccccatagaacatattttggtaagataagacaaaatagatgaggttactgataaagccaaagaaatagttacttgaccgtccttctgctaccaagataacacagataatccctgtccacgaggtaaacaagcccatccagtcctcactagcagaccatacatgtaagataacaggcacactagacaaaactagcaagtagagccactgacctagggtacgaccgaaaaatagtcccgcaatgattgcgtccagaactccgataactcccagttttttggctctatttgcgatagcagacatgttttctggtacctgcttcaaggaagcttgaaaacggtcgatgaatttggtaagttgttccataatgtcctcctaaaattcctgatagatagcatcgattagctcgatagccttggcataattttctgcataagacccaccgataaaggccagcgaagcctgcgggtgatttttagcaaccagttctttcaaatgttcggtaaaggcattgcgaatttctgcgtcagccattgtcatatcccgaaaaccgtcatccacataagagcctgtcggtagaacaaagataatcaggtcccatttttcattcttaaccgtatcagcacagagcgagtggaaagaactagaagtttcgccgatgtagtagtcgtagtaggcttccgtcacggtcgcgttggtgtccgcaatgaccagaccacgattggtatccgagtcaatcaggtctgaggtctggcgatactggcccgtcaagagatagttgtagtccttgcctgtcaactcatcatcacgcacattgtaacgttgctggtagtagcgggcatattccagcgaaacaggacaggaataataacgccccaaatcccgcactagcgtggttttaccatttgaagcagagccaaccaccaagatattcttagaaaaatgacggcggaaaggcttggcaatcatattccaatacttagccgactgctcgcggataagagtggctgaaatgccaaaatttcgctctgtaaaggaagccttgaaaccacgagaacgcaactcttcggcatattcctgctccgaaacgtagaagacgagctcttcgttctccttaatcgccaccaaggcctgcaaggcttctaaccaaggtgcccaaccttctggataagggggcattccctcctcgtctagcttaaagacggataccagaggctcgtcgttgaaggtttcgcggatatagcggaaacgtttctgcaaaccgagaccaatctgatgaccacggtcatttttatagcccgacacgatgacgaccgcccgatcgcattcccgcttggctcgttgaatcaggtcaatatgacccttgtgcatgggagcaaaggtcccaaaaataactgctactgcttgtttcataatctacctttttattgttttttatattttatatcctactcttttctcaaaccaaagtcaagagttttttatatttttttataaaaagatagcaagccgaaagaaaagcaggtctaacctgctttcacactatcaaacttcaactgctcggccttgacccctacttttaaggtcacaccagctggcagttctccacgtaagagcatttctgccaatggatcttccaacttggtttggaggaggcgacgaagtgggcgggcacccatttctggatcgtagccttctttggccaagagtttaagagcagaagcctgcaatttgagggtaatacccttgctggccgccacggcaatcaatggtttgaccatgaccttgaccacatcctgcatatctgcttctgtcaggctatggaagaccactttttcatcaatccggttaataaattcaggacgataggccttcttcaacgcctcaaaaatccgtttttcaacgtgttcctgactcttagacaaatcaagagccccaaacccaactgtcttatcatcacgtaaagcggttgcccctaagttagacgtcataatgatgaccgtattagagaaatcaaccttgcgaccttttctgtccgtcaagacaccgtcatccaagacctgcaaaagaacattgaaaatatctggatgtgctttctccacctcatcaaaaagtaggacagagtatggcttgttgcgaactttttctgtcagctcgcccccttcttcatagccaacatagcctggaggagcaccgttgaggcgactagccgcaaatttctccatatactcactcatatcaaaacgaatcaaggcagattcgtcatcaaagaggatctccgccaaggccttggccaattctgtcttaccgacacctgttggccccaagaacataaaggaaccaatcggtctgtgaccagtgcgaatgcctgactggttgcggcgaattgcccggctgacagctgaaatcgcctcttcctgcccgataacacgcttgtgcaattcctgttcaagattaaggtacttcttggcatctgtctgactcagtttggtgacaggaatacctgacaagcgactgagggttgccaaaatgtcttcttctgtgacttccaagctatagctagtcgcctgattttccgcctcttgagccttaagcaagagctgcgttaccgtcttgtatttcccagccatcaaggcttggtctaaagcggtcaatccaccttcttctacctgtcccttggcacgattttgaaccgtcgcactggcttcatccagcaaatcaatagccgaatctggcaaattcttactggtcagatagcgtttggcataggctaccgccgttaccaccgcctgatccgaaatggtcaccttgtggtgagcctcataggctggcttcaacccctgcaaaattgctacgctgtctgctacactcggttcctcaatggtcaccttggcaaatcgacgtactaaggcagcatctttttcaatatgcttctggtattcatcctgagtcgttgctccaactgtccgcaaagtcccacgggacagagcaggcttcaaaatattggcagcatccaggatcgagtcaatccctgaccccgatcccataatggtatggagttcatcaatgaagagaatcactcgaccatcttcttcaatatcgttgatgatattgttcatccgctcctcaaaatccccacggaaacgcgttcccgcaatgacattcatcaagtccaattccaagatccgcatattgacaagactagctggcacctctccattagcaatccgctgggctagacccagtgccagagctgttttcccaacacccgcatctccaaccaagacaggattgttcttggttttccgcgacaaaatctgaagcatacgggaaatttcctcatcccgtccgatgactggctccaactgacctgagcgggccaaagccgtcaaatcacgtgtatagtcttccaagccaccactttgtgactgggtcatgcccatcatattgccaaccgttgcctgcttgggcttgccacctttcgtcatggtgcggatagccttcagatgctccttggtaaagccagccttggcttccagatttttccgcaaatccagaaaacgaaccttatcatccgaatcctcaaagtgaaaaccgacctgatccagaatttgtgaggcagtcgaacgcttgtccaagagcattcccatgaaaatatgctccgttcctagccccttactcttgacaatctccgcaatcttctcggcaaagacctgcaattccttcacccgcttggacgatggaagaaagaaaaagctctctaactcttcatggtaacgccgccccatcaccatataaactgcacgttcatagtccaatacatccgcaggatattctgctaaaatagctcccgcaacggtatctggattgatgacaaaggctaacaacaagtgccaggtctccaaatagtcactactataacgctgtgcaatcaattgagcatcttcatagacaccctgtaaccctcttgaaatcttcattctaactactcctctttcctatccaatcgacgtaaaatttggtacatcatccgagcccgaatttcactagcctcgttccctaaaacctcatctgtactagtagccaacaagagattgccctcacgttccgtcatcaactgctcgtcaaagagcaactgcagaatgtccgcaaaaacagttgccgacaggctatcacccatattcttcagcaaatcatggactagctcatgcttgtccgaaaaggtaatccgcccaatgcgaatgtagccaccacccccccgcttgctctcgacaatataacctcgactggctgtaaaacgagttttgataacatagttaatctggctgggcaccacttcaaatcgactggccagctcgctccgacgcaactcggctacactgacctgatctaaaatcgctttgatatgttcttcgatataatccgacgtatttttcatcgccatactatcgcctctttctttgactatctttgaccattatactatttttatccactttttgaaagcgaaagcctcacttccacacaaacgtagccaatttttgaaatttgctctgctttcttctataataaaggaaaaaaaaggagaaccccatgaactttcaagactacatccaagattttaccagcgtaaacgtggagcaggcacagagccttctaactgccaatgagggagcggtcctcttcatcggccgtgcaacctgcccttactgcaaccgcttcgcaccaaaactccacaaggttgcccaagacaagcaagtgaccatccacttccttgactccagccaagtcagccctgaactccaggccctccgcgaccactaccaagtcccaactgttccaggcctcctggtcgctaaatctactggtgtccaagtccgctgcgattccagcatgacggaagatgagattgcggcttttattcaagactaatgctagacatttcctaccaagccaacaccttccacatctcttatcaaggaagaccactcggcaagattcacagcaaccaaaatccctaccaccagaccaatatctatctgcgactagatttggttgatttcgattgcaaaatagcaaagcagctcttccagtccctacagacttccttaggcggaaaacctcttcaagttatgctctcctctgcagagcaggaaagaatccatttccttaccacagctggctttgtctgcaagcggaaatgttatgagttcgaagtgaccaagcaagactatctcagtcaaacaggcacttccaacttaagcatagtcctcaaaggcaccgcaccttatcaaatagtctgtcagcaaatttttgaccactatcaaacagtccaccaagacatcaatccttggactgccagtcaagaagaatttgaaaaaggcttacctgatctggtttatacagactcagaaaattgtgccttcatagataccgatgaaattgcctacgtatgcggaaaagatgaacaaagctttggttccttcatccaagcagttatttgccaactatttgaacagtatgagcaaattagctttgaggctgatgactgcgatcctatcgccatgcatttagctgaccaattccgacaaccaaacaagcctagctgggatgcttacattttagaaatctaacaaaaagcaccgaccacaaggccggtgctttttaaggagattatgaaaaatatttaggattgataatagtataaccgaatcaagcatatccgacatccgccctaagaccgattttgccaaaaaagaactccctttcggaagttcttgtgattttgaatagtctatcagtttgcttttagtactaggaaacgagccgcaggctgtactgaagtacggcaaggcgagttaacgaagtaatgaaagataaaatgaagactagcaattatttaccaagagctgctgccattgtcgctgcaacttctgcttcaaagtcgtttgaagctttctcgataccttcacccacttcgaaacgagcaaattctacaactgaagcgttcactgagttcaagtaagcttcaactgttttgctgtcgtccatgatgtacacttgtgcaagaagtgtgtaagcttggtcaacttgagtgttgtcaagcaagaagcgatccattttacctgggatgattttatcccagattttttctggtttgccttctgctgctaattctgctttgatagcttcttcagctgctgcaatcacttcatcagtcaattgagcttttgaaccgtatttcaacaatggcaatactggtttgttaaccattgcacggctttcgttgtcttgttcgatcttgtggttgatttgtgccaactcatctttaacgaattgctcatccaattcagtgtaagaaagaacagttggtttcatcgcagcgatgtgcattgagatttgttttgcaagagtttcgtcaccaccatcaacaactgagataacaccgatacggccgccgttatgttggtaagcaccaaatgcttgagcatctgttttttcaaccaaagcaaagcgacggaatgagattttctcaccgattgttgcagttgcgtttacgtatgcttcttcaagggtttcacctgaaggcatagccaatttaagagctgcttcgttgtcagctggtttaccttctgcaattactttagcagtagtgtttaccaattcaacgaattgagcatttttcgcaacgaagtctgtttcagcgttcacttcaacaactgctgctacgttaccatcaacgtaaacacctgtcaaaccttcagctgctacacggtcagctttcttagctgccttagccatacctttttcgcgaagcaattcgatcgctttttcgatatcaccgtcagtttcaaccaatgcttttttcgcgtccataacgccagcacctgatttttcacgcaattctttaacgagagctgctgtaatttctgccatgtctattctccttgtttgtatttataaaatagaggagcgggctcagccctgcccctctaggattgtttttgtgtctgataaataatgtagaatgtactcggactaaaaagctagaatttagatatatctaacgcttttcttaacgccttcgttacttattttccttctacaacttcaaccaattcttcgattgattctgtagatgctggctcagctgccaattcagcttcaactgctgctacactgtcttcaccttggttgccttcgatgatagcgtcagccattttagctgtaatcaatttaacagcgcggatagcgtcatcgttagctgggatgataacatcgatatcatctggatctgtgtttgtgtcaaccatcgctacaactgggatacccaatttcttagcttctttaacagcgatttgctctttgtgtggatcaacgacgaacattacatctggaatgcgtggcatgtcagcgataccgcccaagaatttttcaagacgagcacgttgtttgttcaacaatgctacttctttcttaggaagcacttcgaaagttccatcttcttccatacggttgatttctttcaaacgagcgatacgtttttggattgtaccccagtttgtaagagttccacccaaccaacggtggttgatgaagtattgaccagcgcggatagcttcgtctttaacagcttcagcagcttgttttttagtacctacgaacaagataactgcgtcgtttgctgcagcgtcacggatgaattcgtaagcttggtcagccaattttacagtttgttgcaagtcgataacgtggataccgttacgctctgtgaagatgtacttagccatcttaggattccagcgacgagtttggtgaccgaagtgtacaccagcctcaagaagttgtttcattgaaattactgccatgagtatttctccttttgttttttctcctctcccgaacttcgacttgcagcccaacctttcggcaacaagaccacaattggtccgggatgagtatttgttgtttagacaacttagtaagtataccaaagttttaggtgaaaatcaagcatttcagtacacaaatctctagattatgccaagctcatagatcgggatatgtctctctttatgttactacttttttattatttttaacttcatccattttactttctatttcttagaaatagaaaggaagtaacgcctatctggtgttacttcctcttagttgtatcccttagataaactgtgatacaatgtctctctatcataaatcaatctctatctcgtaactctcatcaatccataggatgtttgcatcatattttttcgcccttctaaaaaatcgagtattttcttctaaaacactttccatcgtacaccattcatcatctatacgattttctataaggcgtgcatgtttctttatgcttccaaagtgtttctgaatatagttttcactcatcacaagacagtaatatctgatatggtcaaggtaggctgttgcaaagtcgtttgcccaatcaaaagggatatagatcccttcaacaataaggttttgctcattttctatagcaattttaatcatttcacgaacaataggccatagatatgctgtaagtttatcatcttcttcgactgaaagtttagtattgccgctacgaattaaccccattttcaaatggtctattgataaataaggatagtgatatttttcaagtaatttttgagctagcacagtcttcccagtgtgagatgctcctgttattaaaacaatcatgattttctcctatctaagcgacaaagcatctatgttttatatgaaaatttgtaagaaacactgcttgtcatcctatctattttttaatctcttactcaatttattatatcatgttcccacattttttcagttaatctaatcaagtacctgagttatctttgcaatatactgtaaataaaaacaaccgttttagatggaatattcttcttggtttaatctttatttagcaaaaataaactctatcacctccaaatctttcttaaagaggtgcactattatcgtaattctgttcccttaacattccttgcagtaaaaatgaattcacttacccaaagtgtttcttaattctttttgctccactctttttctatcaaacaaagagagtggtactagccatcaatactcaaaaagtactcctatctttttcgtcgtattctcctatgttttcgcaactgttttatagatttgttatcagtcacaaacagtcactagatttttcttgactttcagcttttttttcggtagaatattctttgttatggcggtatagccaagtggtaaggcacggctctgcaaaagcttgatcgtcggttcaaatccgtctaccgccttttaatattctaaaaaacctaggaatcttcctaggttttttactattcttttcgcttcaaatttccgagggccatagctccaccaaatagacctaacaaagtacttataaagacacttcccaggctatccccagtttgaggcagtttcccactagtatccgccgctaatgcacctgtctctcctattccgcttctttcaaagaattctctgtgaggtacggacacttctattctctcgtcagaaattcctagtggctcctcatgttttgtaagtttccccaaatgctccacaccatcttctcttgtatcgccagttaacagcgcgatttcagtggatcctgtttgcggagcaagtgaattctcttcttttggcattggtatatgcgcttccgatttcagaataggaatgctaggggtttgatccttatctgatcgctccacatgaaggtctttttcaggaacctgctcagatacttccttgtcatttaaccgtaccttatatttcttcacaacagcatttccaaaactgtcactcaaatcaagtttgactgtatccccgtctttcagactatgtagctcatagcgaaaggctttttcattatttccatactgcctccagaagcctcctcgagctacaaaatcttcgttgatcttcaaggaccaataaattccattatccttggcgcttccggtaagtgtcaagtgcccatcagcatctgccaggaggactcctgcatactgattttcctcgtcttcatcttcttcactatccactacctgtctttccaatggtagcacctcattttccagctgtaaaacagggttttctgtatcaaccaacatctgatatttcttcgtgtaagtcaactcatctgcctcattgtacacacttatatccacaacatttccctcttcaatcagagtaactggataggtcaacttcccatcctcaaaatagcgtttttcaccaccattgatgcgcacagaatgagcttgttcggtttctgcttctatttcaaatgtaaatagataagtcccatcttcttgctttttgaagtcgaccaacccgctatctagctcacgaccaagactttctttattgaaacgaattgggtcaatcagccagttattgacagtaatcggaacttctgtttcctcctcctcatccagactctctggacttgtattgatacgaaggtcctttaatttatttcccttctcatctaccgcagttaacatgatggctctaggaaaatcagatttaaagaagtcttgctcaaaactgccgtcttcttttacatctatgattttccgctctcccttaccaatgtctagattggaatagtaaagtttgatgtccttaggaagactaacattatcactcactttccctttcaatgtaaaacgcccatttttaccaatctggataacctcttcatcctcttcatctttttcaatatcaagatcaatcgtcggcttttcattatctaccaaataattcaaggttttagtgtaaataaggttgccatccttatctttcaagattaattcaaaactatgacgtccatctgattgctctggaatctggagagatagttgaccattctcaagagagtaattcacagcctgagcatccaagttagcctgtacatcggaaacttgcgctgagacgttcgctttaatttctacagttttcttactgcgaattgccatcaaatcttccaaatttttaaactggattacaggcgccatcaaatctttttcaacagcaaccacattacccgctatatccatcacctcaacacggagatgatttttagcatcgagtggcagttccacttctttgagatggtaatgtagttgacctgcatcatctacaaccttttcaacaagaagatcttctccatttagattagctcgaacctcccaaactttattattatccttggctgtgacgaccagttctctatggctggatagacgattggtatcaatcgcgacaatctctggcttttgattatcaattttgactggcagataggtatactgataggccccattttctttattttttacccgcaatctaaagaaatattgtccttccggtgctggtatattttcatcattgcttgcatcgtacactttcccatcccaacggtgcaattctatcggagtacgaagcttggaatactccgatagactttcaaaataatctacatagcgaacacgagacagcatggttcctgtatcaattcgccttaaaacaggagcatcttctgtagcttcttttacaatatccaaatcatagttggtaatatccctcaatagcgcaaatcgaacaaaggcattcccaatctgactgtccgaatgctggttttgaattgcgatattgtctggattgagaggcgattgattatcttgaatcttttcacgcccaagttcaatatagcgcccagacttattgtgtttatagctagataaaactgaggtcagtttcaatttagaactggtttcccaagccggtgcatcaacaatcctttcttttgaccagtcaccaacaaagccaaaataaggtatgctgatgtcagactgcccctccgtcaatgatttgaagtaaatatacccttctgcaaactggtctttcgcttctcctgcatccaatttcaggcgaatggttctcttctcttttggacctagttgaatggattgctcagaaagatgaatactcgaccccttgatttctgtcgcatgaatctctttaactacttttccagaacgtcctattctatcaacaggaacatcttgactagtcaacactttcccagctgaaatagcaaagcttctttgttggtttcccagattttccaaggttacctcaaattctgtctcacgccctatttcttttaattccacccctccttttagacggtggtgaagaatcacatctgtttcaaaggctctatcaatctgcaacagaccagcaccttgttgtctcggagaattttccaaagcatgcccagatgaatctagaacatcaaccaaaggggtagcagtattcatcaaaatgattctcagcaaatccatcctagtcatgccttctggtggtgtcatttggcgaatccgtggcaataaaagtgcgctggcacccgccacaattggcgaagccatcgaagtccctgacatggagccataacgattgtcattcaaggttgcataaacatcctctcccggcgccacaatctctggcttcaattctaagttgaccgtaggtccccaactagaaaagcctgatacagtcggcacttcaatcaacttcttcattccaattgtaggtttaagaaccaaaccagtgttgccttgcgattggttggcaacttctaataatcgccttccatcttccccgctaagactaattccccagatagaggagtaggaaagcaaagtcttatcatctaccaacaactgatgggtcctataataatccttgttccatccctgatcagtatttatcacaataattccagcaacatccttgaatttcaaattacgaacagcatctttcaagtcaaacttatcttttttgataaccgctactttaccagccaaatcaagcccttgcacttcttcccaatgaccatttccagcatctacaaattcatattttccctctgtaagcgttgtatagccaataggatagtaaccaaaagactgtccattcagcataaattctcgttgaacaagatgggtatttctcgccgaaccaaccgcgataactgcgggagtcgctgctacaccaactgttgttgccgtatccacagctcctaaggcattatttgtatgcaggtcaaaggaggtgtctgaagaggaggcaccagcattaccaatagccgctgtaatgataattcccttttctgctgccctcttagcaatcgtgtagtaagcattccctggtagcccgctatcataataaccaacactcaagctgatgacatctgccccgtgtttgatagcatcttcaatagcagcataagcagcatcctccgtctcagctttataatttttagggtcatttgaaaaaatcttgtagactagcagttgtgcgttgggagcaatcccatcaactccctttttagacgcaacttcttcgtctgttgcatttccagccagagttcctgctatgtgcataccatgtggttcgtgggtatcatcgtagagattatcgttgccagatacataattatagccatggggaactttcaatgtgtatgtccctgtcgtagatggagtaatgtccttaattttaggaatgacaccatcatccaacctcatgtctttgtgcttaatatccaaaccggagtcaatgactgcaatcaccattccgcgaccatctgtctgatatttagaacttgcttttaaggcaccaaccagctgtttagcagtatgaagagtcggtcggatacggcgactctcttctaaagaggttaattcggtaattgccttcacatcagacaaactttctttccctacctctactgatgctcccgttaaaacctccttatactcatgaacaattttaacgccatcaattttctttaatttatccaatacaagatttcggttctcttcggaaaattgtaaaatatagcgccctgttgtcacctcttctggctcaagctgtgattcctgcgggattgtttgaggagcactagcttcttttccgctaatgtcttctttttcctttgactcatctgttgtcttaccagctgtagtttctatctcggtcgcagcttgatctgtgagaagacctgattcttcacccgcctctgtatctacaacttcttcgaccactccctcttcagcaactggttcatccacctgctccgttttaactggatcatctgataatggtccatcttcttttttctctaccgcagaattttgcctactatccatatctgttgcgaccgcaactgtagactccaatccttctccactagtatctgcttgaaccatcggaacacccgtgataaaaaatcctattgataccgatgccacaccgacacttaacttcttgatactaaagcgttgtttattctcaatctgagaccacttctgtttcataaaacctccgttttttaagtttaattaatttataagttaggtacacctaattctataaaatttttaaatctttggcaagttttttttgaattagccctcaaaaacaagaaaaagcacaggcttccctgcgctttaacaacttattacaactcagcaatctggcttaaattaacttcagcaatggtatcattaccaaacatagagataaccattttaaccttgttgttgtcgatttctgtaattttacctgtgtagtctgtgaaggcaccgtcgatgatacgaacagtgtcgccaactttgacatcaatatcaaattcttgaacggtttgtcccatagacaccaagatttgacgaatttcttcttccaaaagtggagttggttttgaacggttaccgtgtgaacccacgaaacctgtaacatttggcgtattacgaaccacaaaccaagcttcatcggtcataaccatctcaaccaaaacataaccagggaaacggttttcttccacttccttgacctcaccgttcttttcaacctgaacagtctgagttggaatttctacacggaggatgttttccaacatgttataagtatgggcacgttggagcaagttttccttcactttattttcatatcctgagtaggtctgcaaaacaaaccagcctttatcaaaactatcgtacattgttacttcctttctttggaaacacggaatttttagacgctaaaaaaagcccgaaggctttcgcttttccttattatatcacttccattttacaaatggcaagtattttctagaaaagattgatcaagctcatgattcctcgtgacaaaatcaagtcaaagaggtaaaccaccgctacgaaaaaggcagtatattccactacagacacgaaatccgtccagctctgcttacgagttggccaagacgtatcttttaaaatgcggataatgtctttgataaatttcatgcgtgactcctatctggtttccttgtgaacagtgtattgtccacagtgtttacaaaatttatttacttctaaccgtgttggcttgggattgctcgaaaggctgattgaatagtttcgagaaccacaaacagtacaggctaggcttgctttttttagtgccataaagccctccatccttttcattctaccatgtttttatggatttgacaactctccaaaccaagacgttatgttatcccacaaggtttttgctcgttctggtaactgggcatcgattagattttgtttggtttgctcaatcaagtttttcgcctgttctgaaatttcttgtacctgttcttgaccaaggcttgattcagtttgcgcagcttcatctggagctacttctacaataccattttgtgcataggcgttttctacttcgaacttacttcctgcagtatatggcaagattgaattggccacagtctggaagaccgacggagccttccagtagctactgctatctatataatgattttcatctgtctgctcaaaaccaacccactgactgatgaccaaatcaggtgtgtaggcaatatgccactgatcattgacgagattgacatcaaaactcgtttcggttgttcctgttttcccagcgatatgataattggccgtatctgctgtcactcccgtaccattggtataggtaccaagcatcattgctgtcatcttatctgcgacagcacggtcaatcaccttggtacttgtttctcgatgctctgctaaaacctttccactagccgtttcaatacgagtgatgaggtgggcatccttcatcacacccttattcgcaaaagtagcgtaggcctgggccatttgcagaggattggtctccactccagaaccaattgaaacacccaaaactttctcgacattttccatatcaagtccaaacttttgtccatactcgaaggctttgtcaatacccaaggtgttcactatataagctactggtaaattgtaagagagagccaaagcttgatacattggaatggtatcagaagtcgaataatcatagttatgcaaggtgtaatcgccgtaggtttctgtatggttatccagagccatatcaatcgaccagcccgccgctactgctggagcataggcaacaagaggcttgattgttgaaccaggactgcgcttggcttgtgtcgcaaagttgaaggtccgaaagaccgcatcctctgaactgttaactcgaccaaccaaggcgcgaactccaccagtcctaggatcaagagctacgctggcagcctgagcatgggtaccatcaaaacttgatgttgggaacatagtctcatcattaaaaatcacctgcatgctggcttgagaattttgatccatctctgtgtaaatcctatagccgttattaataatgtctgattctttcagtccgtatcgctcaatcgcctcagcaatcacagcatcaaaataggatggataggaataattgctttgtttccctgtataggtatctgaaagctgactggctaggtctacttggaaacctgcatctgcagtcgcctgatcaatataaccagcattgaccatattttgcaggactgtatcccgacgattaactgcattttctagagaataataaggattataaatctcaggtcccttgagcatacctgctatgacggccgcttgctcaagagtaagattactagctggaataccgaagtacttttggcttgcatcttccactccccagaccccgtttccaaagtaggcattgttgagatacatagtcaaaatttcttgcttgctgtactttttattgatttccagagccaaaaagaattctcgagcctttcgactgatggtctgatcctgagttagaaaggcattttttgccaattgctgggtaatagttgaaccacctccagaccgacctaacgtcaaggcagccaaaattgtacgctggtaattaatgcctgaatttttgtagaagctccgatcttctgtagcgataacggcattctctaaattatcagagatagcatccagctctacataggtccccttctgaccagacaatgtcccagcttccgcaccatctttatcgtaaataatcgttgtggcttttagcgcctgctgtaaatcaccaacattagctgtctttgcaaggaaaaatagatagccacctactgtaagaactgtcaggaccattaaaatgattaaaattttagtcagttgataacggcgccaaaatttacgaatcggctccggaatacgtgattttttctttggtttatcaatagagccacgatttcccctgtggcgacggctaggtcggtcttcatgatcaatttggaaatcttctggaacttcaatcggctgatgttgcaaatcgtccatactttacctctttctagtgaattttgtaccattatacaccatttcctaaaaactagcagaaaaaagcctgcgataacttgtgacaacatacagggaattttttccaaaaatatgataaaatagggtcattctgaacaaagaagaggattcctatgacacaagtatatgacattactatcatcggtggcggaccagtcggtctcttcgccgccttctacgcccatctccgtcaagccaaggtcaaaatcattgactcccttccccaactgggtggccagcctgccattctctatcctgagaaggccattttagacattccagcctttccaagcctgacgggacaggagttgaccgacaacctccttgcccagctggctccatttgacaccaccatctgcctcaatgaaaccctgactgctatcgaacctggggaaaccattaccctaacaaccaacaagggcaaccaccagaccaagaccctgattatcgctatgggtggcggggccttcaagcctcgtccgctggagattgatggtgctgacagctttgacaacgtccattaccacgtgtctaatatccagcagtatgccgacaaggacatcgtcgtcttgggtggtggtgactctgcggtcgactggtccctggcctttgaaaagatcgccaagaccacccagatcatccaccgccgcgataacttccgagcccttgagcacagcgtggaagagctcaagcagtccagcgtgaccattcacacaccttttatccctaaagggctttctggggaaaatggcagagcttctgccattgatttcgataaggtgaagagcgaggacaagctgaccctgtcttttgaccacctctttgtcaactacggtttcaaatcatctgtcggaacgctgaaagaatggggattggaactcaatcgccaccgcattgtcgtcaacagcaagcaagaaacctctgtccctggtatctatgccatcggtgactgttgcttctacgagggcaagattgacctgatcgcgactggactgggcgaagccccaaccgctgttaacaatgccatgaactacctcaatccaaacgaaaaagtgcaacccaagcactcaaccagcctataagatgaaaattgatattcgcattccccaagcctttcctcaactgactgtcaaggaagtcttggaagattattttctcattcccagaaaaattcgccactttctccgcaccaagaaacaggtccgtgtcaacggtgagctgattaactggcagtgcccgattaccgcaggcgacttgttagaattgacctttgaccaggaagattatcctgaaaaaagcattcctctgggacaggcggacttggtggaggaactctatcaagatgagcacctcattatcgtcaacaagcccgaaggcatgaaaacccacggcaatgatccgacagaaattgccctgctcaaccatgtgtctgcctatgtgggacagacttgctatgtggtccacagactcgatatggaaaccagcggagccattctcttcgccaaaaatccctttatcctgcccattctcaatcggctcttggaagacaaggtcatctaccgtgactacctagccctctgccaaggccagctaaaaatgactgactggactattaccgataagattggacgggaccggcatgaccgtagaaagcgagtggtcgacaaccgcaaggggcagacagctcttacccaggtccgcctcttgaagacccttggtaaaaatagtctagtttcctgtcgtctccaaacaggtcgtacacaccaaatccgagttcatttagcccaccacggtcacgctctaatcggcgacccgctttacagtcgagtagctccccctcgcctcatgctccacgcccaaaaactcagcctgacccacccgctgactttagaagaaatcagcgtggaggcgcggtcggagagttttgaaagaatagtaaaaaagagctgaaaaaccagctcttttttgcatgtatgttattcaaaaatatttcccaactcaacatccacgcgattttccttgacattgatgtcggtcacagcgagcagagacttgtagttagctacgctacggtcccctttttggttttctgcaaagacagccacgcctaccaaggttgagtcaaactcagacaagaggctaatcataccattgatggtgccaccatttttcaagaagtcatcgacgattaagacacggcttcctgccttcaaactacgcttagacaggaacatcttttcgatacggtcgctagatcctgacacatagttgacagaaactgttgaaccttctgtgattttcaaatcacgacgcacaatcacaaacggtacattaaggacattggcaacagcattggccaaagggacccccttagtcgcaactgtcatgaccgcatcaatcttctcatctttgaaagcatctgcaatgatacgaccgacatttttcaaaatatgtggtgtagacagcaagtcagatgaatagatataaccgcctggcaagatacgattactttcggccatctgatcacgaagggcctgtgcaatttcgacagactctgccttagagatcgatggagtaaaaacaactcctccactggcaccagtaatggtttcaatatgcccgatagagctttcctcaaaagcctttttaatgatggcaatatcctctgagatagatgacttggcagattcatacttttccgcaaaggtattcaaactagttaattcataagggtggttgatgaggtaattggaaatgacaaccatacgctcacttcttcttaatttcataaaatcatcctctttcacttttttctattatatcacaacaaactacaaaaagcgaacttttttgattgaaaagtccgtctttttcgtattttgtttatcgcttacatataccactttggaagatgatgattaaaatattcataccattcagaaatcttctgcgcttgcaacttcatcaatggaatttgttcggaatctacttgttctgcccaagaaagagcgcctagactatttactgttacataaagagccatgagtttccaaaattcctctggaatagcgccgtcaaaatagacatctacctgaccacgcgcaaaggctggagacaaatctgccgtgaaaatcaaacggttaaattcttcccaggggtctcctatgtcgtagcggtcaaagtctaaaattttcagtcttccatcctggccccgtagaaagttacctgtgtgaaaatctccatgatggtaggcaatcggtctcccttcaagcaagtgacggttggcctgaacaaaggctatcatggcttgaccatttggataggaatgactagctgcttggtaggcagctaatttattgtcaatcttagcctgataaaaactgttccagtcgcgcagactttgatcaatcggtagggcatgcaaggttcgcaaaaacttccctgactgacagcccaattcatataaggtttgttctgacagactggtagccaagtcattcatatcctgaccttccatccattcataaagggtgtagactgacaagtcatccgcccaaaaacttagtggctctgccacaggcaaacctagaccaaacaggttttcaactaactgaaactctaattgcttagcctcataggctggccgctctgctattctcaaaagaccaaggcgaccatcttctagctggaccttgtacttttggtccgtggaccagcctttggtgaggggctgtcgagacactatcctaactgccatcagtcgatattgggcttatagaaggcgcgattatccatggcaaagatgcggttggtcatctcgcctgggccgaccttgtccaaggccgatagcatcatcatcatttccgcatcaatgttgtcaatcatgtggaggatttccgcctccataatctgcggacggacagggcttccatactccaagagcccatggtgactgaggataacgtggcgcagaacagtcacttcctccagactgtcatcgatgcccaattccatcaagaccttggtaatctcttcatcaatcaaggaaatgtgaccaatcagattgccacggacagtgtagccagtattgtctggaccagtcagttcgatcaccttggctaggtcatgaagcatgattcctgcaaagagcaggctcttgttgagctggggatagatgtcaccaattttatctgccaagcgtaccatggtcgctgtatggaaggacaagcctgagtagaaggcatggtgattggtcttggctgctggataggaatagaattccttgtcgtacttgctgtagagagcacggacgatccgctgccaagtggcattttcgatgcggaaaatcatctggctcaaatagtccttggtgtccttgacatccacaggtggtttttccttgaaatcagcagggtcgttgggctcgcctgcctttggcaaacgaagaaccagttgattgacctggggggtgttgttgtaaacctcacggcgcccctgcatgtgaacaacagttccagcagtaaaatccttgattttccctggttgggcatcccagatcttgccttcaatctcaccagtatcatcctggaaggtcagagctaggtagtcttttccagcccgtgtttgtcggacttctgctgacttgattagatagaatccttcgaagaattcatcttttttcatttggttaattttcattatcttcctcatctaatggggacaggccaagcagccccttggtttggtcatcttcgtacaggtcaatggtacgaagactacgctcgatggcgttggtgcgagtggttaggagtttgtcaatattgctgctagcttgattgagctgtttctgggccttgaccaagaggtcagaaaacttgccaaattccagcttgacattgcccaagaccttggaaatatcatcggccgaccgttgaatgttaagggtcttaaagccgacggagagggaattgagcagggcagaaagggtagtgggtcctgctactacgatattttcctgacggcgaagctcatcaaagaaaatgggattgcggaccacttctgaatacagcccttcggttggcaagaacaagacgccaaagttggtggtttcaggcggattgaggtacttgctctgaatgtccttggcaaaacgtttgatagctgccaggagatttttgcgatggaggtcaatctggtccttatccccactttcgtaggcatcttccaagcgataatagtccgccagcggaaacttggaatcgattggcaagtagatatagtctccctcagtccgtcctggtagcttgaccgcatactccacacgctcactagagcctgaaactgtggcaaactctcgctcatattggctaggtgtcaaaatatcctcgataatctgtcccagctgcaattcacccatgatgccacgggttttggtgccagacagcaccttgttaagactacccacatcacgcgccaccgtctgcatttcacccagaccacgattgactgattccaactgcttagacaccatttcaaaggaggcttgtaggcgggtttgcagggttttctccagcttttcctcaaccgtctgccgcatttcttccaggcgtttttcattggactcctgaatggcctgcaaacgaaggtcggtggcatctcgcgtttccaagtggctcttattcagctcttgacggatgtcggttagctgttggtaaagctccgtgcggagtctttccacctcctggtgaatggtctgctgctgtttgagagttgcattttctagttgatagctgagctggtcagacaagttgtctgctgtatcttcggcttgatcttgcaaaagcagggccaagctctgccattttccataaagaaaaaccaaggcaagcaagaccagtatcagcaaaataagtagtacaatatccatctaatccttgtccttactgtagatcaggaccacatagccctgatccagttgaatgtctatatccctatctataaattcgttagaagcatagcattttttgaaaaaataattgctggcatccagcgggtacttggcataacgaatggtcaggtggctttggtccgacggcataaaggaaatgtacttcataccagcaatcggcgaaatcctatgactgcctgcaggtcgaaaacggacgacgttctgactgtccaccaattcaatctgctccatataggctgccaagtcgggttctgcaaccagaaagagattgctcatcatgtggtccatgcgaccacccaaggctccgtatatgcgaacctgggcctgcggataggccttgaagatttcctttaaagccaactccaagtctgtatcatctttttcagcaggagcttgcagaaactgctctgccatctcccttatctgccccagctcctcagaggtcaccgagtcaaaatcaccgatagcccagtcaagaggcagggaatggtccagaagacgaagagagcctgcatctacccccacatagaggtcggcaggctcaggaaggcagtcaaaggaaccgcctgcaataacagcaatcttaatcattgagggcagctctcaatttggcaacgttggcatccaagtctcctttgaagagataggagccagccacaaagacattggcacccgcacttttggctgaatgaatagtcttatcgtcaatcccgccgtccacttcaatatcaaaggccaagcccttggcttcacggagtttgaccaaatctgcaatcttatccgcaacctctggaatgtaggcttgtccaccaaaacctgggttgaccgtcatgagaagcacctgatccaccaagttaagcacaggctcaatggtcacaagcggcgtacctggattgatgaccacacccaccttcataccagcagcacggattttctgcaaggttccatgcaagtgaaccgttgcttctgcatgaatggttaaaatatctgcgcctgcacgtgcaaaggtctcaatatgattttcaggattggacaccatgagatggcaatcaaaaaccagcttgctatgaggacgcatagccgcaaccacatccgccccaaagctgatatttggcacgaaatgaccatccatgacatcaatgtgcacatactccacacctgtcttttctagacgcttgagctctttttcaaaatttgcataatctgccgccaaaatagacggtgcaatcttaaaatgtgacatagagaaccaactttctatttgaattttttactgactttagtataggtttcacgctgattttggatttcgctgaggaattggagataattatcaaagcgactttgggaaatggcagagctggcaacagcttccttgaccgcacaatccggctcatgggtatgggtacaggtcctaaatttgcaatcctggctactttccgcaatctctgggaaacaatctgtcagagcctccgcctccttgacttcatagtctagggatgaaaaaccgggtgtatccgcaatttttccaccgaagacattgtagaagctgaccgcacgagtggtatggcgaccacgccccagactatctgaaatcgcccctgtttccaaggctaattctggcgcaatgcgattgagaagagtcgatttcccaacccctgtctgccccataaagaccgtcaccttgtcctgtaaaagaggcatcaattcctccaaactatagacaaaaggatagccaattttctcatagatagccttgaaggcatccatctccgtccgatcttctaccaagtccatcttagagatatagataatgggatccatatccttctgttcaaggagaactaggaaacgatccagtagattggcattaaaatcaggttccttggccgacatgataaccaccgcctgatcgatattgacgataggaggtcgaaccaaactatttttccgctcatgaatctttaatatatagccttctgagttttcctccgcagaaaagtccacaaaatcacccacgtagggcgtttgtcccttcttacgaaaatttcctctagctctggtttgataaatctgtccatccgcctcgacatagtaaaaacctgccaaggccttgataattcttccttgcaatgaagactcctttgtgtgtacttgttcctattataccaaatttcctaagaaaaaaggagcaggaaagaactcgaaccttaataaaagagcgcgtcacccgttccacgtttcaagttgttgagctgaaacagtctattcccagactgtttcaatcccacccccgcacagctcaaactgtctgggagacagtttgaggttggatataaagcgaactttgttcgcaacagtcgtaatggttagatttggagtgtaaaacacgaacgattctaccaatcaaccactgcgctgagatgttgacactaaccttatgaagtgagatggtcttttacccagactctgagattttacactttactctagtcatttcaaataaaaaatagtataataaaaagcaagcggaggtggtggaacggcagacacgcatgcttcaggcgcatgtgcccatcgggtgtgagggttcaaatcccttcctccgcatgataaatggagagaccccaagtcaaagttgatgacttgggggcatttttatatcttctcactcatactcaatgaaaatcaaaaacagactagctccaaaggttttgggaacctttggaggttggaaatagagcgaacgtagttcgtttctacttacgcagatagaaccctgttactattttgtttcaaaggaacaggctgggagtgggaaagaactcgaccattcatagaagagttcgtcttcccaccccccgcacagttgattaggtcagatttggagtgtaaaacacgaacaaatctgccaatcaatcactgcgctgagatgttgacactaattttgtgaagcggtgctgtgctttttgcccagcctcgctcatcaaatcaagtcaacaacgtctgattttgattttcgaagagtattaattgctctccccaatccgtaccaccccatcataacggctaaggacctcatcggacacgcggtgggaaatatgaatgagcgtcttatcagctagtgaggcaaggtaattttcaatcactgcataggtttcctgatccaaggcagacagactttcatccagcaacaagatatccttatcttgcagcaaggcacggatcaagagcaggcgttgcttttgtccaccagacagtccgctatcatcactaatttcctcgctcaaagaagcataacttgggaaacgactgtcaaggttcacggtcttaatgtgaaacatcagcctatcttctggaacctcccgtcccatggtcaagttatatagaaccgtatcatggaaaagggatccctcttgtggcagataggcaatcttgtcttgaatggcttggtaggataagtctgaaagagagatttgatcaacgtaaatatcccctgcttgcagttggctattcttggtcaaaataagagccaaggaagatttgccagaaccactttccccaagaattaaatacttcttgccacgctcaaacgctacggtcaggtcttcaaagacctgtttttcaccgacagcataactagccttgaccagttgaatactctggaaagctgaagctagttcctgtcccttcgtttcttgaccaaaagtagatagctcaaactcttgctttaatttcttaacggcatgcctgtccaaaaaggctgccgcaatgctattaatgggatccaccaactgctctgaaatggtcagaatagctgtcaagccaccgatggtcaaggcaccagaaaagacttgaaaaccaccgataaagataatcgaaagagtggtcagataaaagacaaaaccgactaagagccgcatggttactgtcgttcgagtggcctgattgaccttgtcattgactgcttgatagcgatcgttcagaccatctaaaacttgctgtctttggtggctatttttcacttgcaaataactcagaaagacatctgaaactcttgtattatagacctgctgactgtccgaaatcgcctcctgattgagccttctccgctttttaaacaaatagggaatcacaactggtaagaatgagatcagaatcaagaaaatagcggtcagaccatccaagctaagaagggccaaactggcaatgccaaaggtacaagcaccttgaaaaattgtaaagaaagcgtcgtaataatcttctttcaccgtctccaaatcattattgagctgagaaatataggcccctgccccctgctcaacaaactgcctaaaaggtaaatcaaaaattttcccaataaaggtcgcctgcaattggaaacctacttgattgagatagctgacattggcaatctgacgaatgtattcaaaaaccagcatgacaaggacagttaaccccatctgcacaaaataagacacaaaggcctgtctatctccagctgcaatagcatcaataatatagcgatattggtacagaaagccaacatttagcagggctactgcaaaaatacaagataaggttagccaaaaattcctctttttcatttcttctccaccattttatagatttcttcgcaaatatttctagttgataacccaaccgtctggagcaaaccttcccaatcatttattttccttacaatattctgttcgtgattttgcattgaatattcttcaaaattttgaagagagtaagaagaaaactcaccatccggaaagaatgtacacggcttaatatggccactctcattgattgtccattcaataacacctgctccgcaacgcattgtcccatctacaatgtcttcaaaatagttaaagcaattatcttcttcccatgtatgtatattaattctgctcccatactctctacttttttctataagcatctcataaaattcttctactttagagggacttaaaaaccaatctgatccgactaacttacctctacccaaatgactaaatagcccaaatctcaccgcttttacttggtttagtattaaaaattctataaaattatcaaattcgtcgataagactgtttcgaacaatattggtcactgaatagtctaaattctcattgtttagaaatcttattcctctaatcgttttatttaatgtatcctttccattggtaatttggtcgtttagaatcggattatgatgatataaagaaatttgaatgtagctcattcccttcaaataaattatacttttggaattaattaaatgaccagtggttgtcattgttacttcttgaaagttctccgtagcatattttgaaatctctttaaaatgaggatgtgccatcggctccccacccgttaactgtatttcataaacctttccttttaccctatctaaaaaatttattagctcttcatacttcaaaaaattcctgttaattggtccagcttccttaaaacagtgtgtacactgtaaatgacatttattcgttaattctataactattttcctagggtaaaatttcccaacttcaccataaatatgcttcggataaacagaaactcctttaacaataaactctttcttcaagaataattttaatgtatccaataatagcttttttatttttgtttcacattcccccgctatatcagagaagtaacctatcaaactttctacactacccgtttcgtttatctgttttaaaactaacgcttgatattcatttaataagtattgaccgtattttcctataaccatcaaatcttcaccaaagtaatggtagtagtaatcacaatttagcataaatttcattatcatattctccttaaaaatacgtaaatttatttaatggaatcaatacactattatgtttttaaaatacaataagtttaatcaacgaaacttgtagcgataataatataaaaaatctctgtcaactagactaattttactaatcgaaaaaccaaaaattaataccatccttttgtttgctgtgttctttttgttccacatccactgagggtttcaattttacttacttttaataattttgaagacaactttttaaattcaattacagacatattcttctccttttcttgtccaataaataaatttacgcattattaataataaattataaatataggacaacaaaatatgtcccttatacgcaaccactactcaataagtatcttttccaatatactttcataccaatctgctatattctggctatcgaccgctcgtaaaagtccaatacactttctcatctccaaaatagcattagaagttccggtattttgataatcataaaaagccttaccaaatttaaacaaaatgcgttcaaaaatttctgtctcgtcgaaaagcaaaccttcgatagtcttttcaagaaagattgcgtcgacaagttccttagtttgaacgctgactagataagcactaaggagaacttgagaaactaccaatcgatgttgtttcatttcacggtaaaactgtgtacgatgaattaactctctacaaaaaagcatcattgtttgatgacccaatttgtcaatcgtattcgcaaatagtaagatctcatagtagctccaattctcaactcgaaataagtaatccgttaaaaaggctgtatcttctttcgaaacaactattgtcttatctaagtttctcagtttataagcgattaaaatagcattcaaccgatgaaactccctacgagaatctctttctgcttttgctaattgttcagacaagattttctttatggttacaacatctctgatatagatggattgttttagttgttccaaaattctagtcagctcatcttttttgaaatcctgactggcatacacgaactcgtccacatccacattcatttctgccagcacaccaaataatttactaacagtaatgtcggattccccattttcaaaccgagaaagttgagaagtagaaatatgtcccttggcgacctccgccaaactcttcccctttccctctctgataaatttcaacgttttcccaaaacaactcatttccagacctccttttgtatataagggatttgtttaaagcataacttaatagatgttatcatgattttaaaataaatattatctatattcaacaatggggaatatcaatgaaacaaaattatctaattgcaaacattactatcgttttaattttacttattagtatcctaaaagacattccaccaatcattgttataaaataataatactcaacgaaaatcaaaagtagaccaccttcaactatcttccagatagttgaaggtggaaaatacaaaacaatgtttgcgtcttcaagccgacgatagaacactgttactttcttattttaaggtaacaggctgaaaagttttccattcatcaagactcttgacaacggataattttgatttttgaagtgtataaacacctttattataccactccttcccatatttgtgtccattttcacataaagaaaaaccaagccagctatctgacttggtcgtgattttattctgtcgtttcagtcgctactttgaaaaaatctttgtatttcaaaaggtatccttttcctgtagataggtcatattggaccagtttgagttcttctgcaactttcgcatctcgctcagcctgtcctactcggtccttatgaagtacttctgtcaagagggcatagtaaggactgaccttgttattggtcgtctccagcatcagtgcattcatgtcgctagagttaactagctcataattgtatttcgctgtatcaaaattgctccaaacgaaataatctgtcttatactgcgcacttgggtccgtcacgaaagctgactctggatacaaacctggcaaatggtccccgtaaaaaacaactgtcactttcttatccaaggtcttaagctggtctagaaaatcccttgttgcctgatccgtaaaggataggaggcgaacatagctggtcaagttttcattttcctcagccgtgaagccctcacccgatgctattatacctgcaggctctagagaattccactgaacatggttctgcatggtaatagccgacacaaagctggtatcggcagaacgtacctgatccaaaatcaagtcataggtcttcttgtcactgacaaaattcccctgataatcctcagccgtcacagtaagaggatacttggcactattgagagtgtagaattgctcaatccccagctgcttatagatagaatttcggttgtaactggtatcgtagtaaggatggatggcaatacgattatctgctggatagaggtcactgatacttggcaacttcttcatatttggcgccacatccagatagactgaagaaatggatgagctgtaattgtagaagggcagaccactatagacctgaaattcgatattagccgtaccaccaccatagtggtcactcttcatcaagccactggtagtctggctcatgatgtactcaatatttggaaggacattttgactaagggttacacctggaatccgacgcgggtcagccaaactctcactaagaatgtagataaccgtctggtcagtcaattgacctgtccgttctgcattgatttcctcagccaaggcggtatacttcttcacaatggccttcatggtcttctcagagtaattctcaggcatttccatactggtcttgctgagttgctgcaaccagaggaatgaaagagtgcgataacgagccacaaaggcgtagcccttccaatctacattccgccagttattaacctgagaaagaataggaatccagccagcaatcttatggtctttttcattgcgaattgcccagcccattcctaaaatcaaggatacgatgactgaaattcctgccagccttttccagatagaagcgacaatccttccttggaagtacttcttgtgaatacgtcggtagataaacacaaggaggactataaagacgagcgataccaagacaacacgtagactgataaagctgagaatcatccccaagttcccgacccatttgaaatcattgggggtcaatggctccgaacggtagcggaatttgagaaaattggccgtaaccaaaatgacgtttagactagcaatcacggcaacagataagatttggcggttgataactaggctaatgatgacattgaggaaaaagaggcaggcaatctggaagacaatagcccctggaaagagatgacgtgtgaaataagaaccagtcgctccagccatagaagcctgataaccaatatgcgatagcgtagccagtgccaaactgataaagagcatgctgtagacattggttcgattggccttaaactctacaaatgccttatgaagatagcgaagaaaaatgtaggtccctataaaatggataggtgcaaacaagggtgtctggctgaaaaactctatgtaagaacctttctcaaccaaactctcataatggctatctttccaataagatatagctagtggactgagagaaagtaagctggtcaagagcaaatagccatctggtaccaagtgattggctgaccactggcttaatttttctcgaattcccgtcttcttccgccataaaaatgccaacaatacaggaagagccaacatcaatagaagctcaaattgaaagagattattccggaaaatattccagggttgatacttcttggcattgagccgatagaccaggttgataagatatagaaaacctagaaaatagccgacatacttggcaaaggttttggtctttataaatttctcatatttatcaagcaagaccaatacataaaatgtaaaaataagataggcaatcaagggcaagggaataaaccagagtggaaaagatacatcactcagtaaaagggctcgccccatagccagcaagacggtcattaccatgaccagaataaattgcttggttgccttgagtttgatttgtttcatagcatttctctcttaggaaatatttgattttcggtagataaaggtataataaatcgaccaaagtatccagccagtcaaactgataaagataactggcaataaccaccattgttgcttataggagaggattagggtgttcttccctttttggctggtaaccgttggcacaccaatagtggaaagataataatccatcttccctaacctctttccattcaatgtcaattcactatctcggtaaataacaatcggtatttggatttcctctgattgatttgccgaccaacttatttttaagctatccccaaaaacttgcttattaaattgctggttaggtaaaataatctggtcacggtaacgatcataacgagatttagcctcatttaccgcacgaacattctcttctttttcagataacaccggcacatagtcgggagttgatttctgagccagttgaacaaactcacctaaattttttgaatgcaaggatgcacgtaattcttccgttgttccgtatagagtagtatgaagcatatcttgtaagaattctgctttgttgtactggtcattgactgcttgattatattgatcccaagtaaaaccaacaccaattatggtagataagattgtcaaccccaaaaacaactttttacgtacttcgtaatctgttaattgaagaccaacaatcgtcagaagtaaagcattagcatacaaaaagaatctaaagggaaattggattaaatccactaatccaatacctttaccagcaaatagttgccacggaaaaagatttgttgaaaaaataaaaaataccagaaaagttactgtcagacccctcaatatcaccgattgcttcttccattttttcagcataaaataaagagaggttgcaaaaatgattggtagagagtatggaaagtataagaaataagccttagaccaggtaactgttgactgaataaactttttgtttataaatggtgctgctaattcatttgttgcatttacatataataagggtaaccagatatttacagttaaaatcagaaaaactccaaccgaaaacagtacatctttcattacgttccatttgtcttgcgattttaaccaaccaattgaaaaaagaattgcataggctaagatgagaaacagagccgacagcatgtgtatctgcaacattaaccctacagctcctgccatcagaaaaataggaactttaccagtttttaggaatcgaactgctggaatcaaacaaagcggaaataaggccactccccaacttgaaaatccttgagctacccaccagtattgaacagagtaggtagtcgcgaaaaacatggataacccaacagatagagaatagagtactttcacttctcgcattagaaaataaagcgaagtggcactcaaaactcctaaaagaagattagacagtagttggtatcgataccaagttccggccaacaacagcaaggctccttgcaaataggctagatatggaccatatagagcattgacaatccttccagattgctgatagccatgcaagctcattatataagaaaaatctcctgacttaatttgtatagctgtatcataaaaacgattataatgaaaaacaatatcgtctcctgtcaccactgcttttgtcaaaatctgtggcaatagaagggtgagcgaaaaaagaaaaaatacagttactgcaacaatatctggatgctttttcagtaatttttttaacataagataccttcataaaaaaagagggaacccctctcttgtttttgtaagaacctgtactcagaagtgaagtgattatcaataagagatagtttttcgctaatcaaggcagttttattgagagaatactgactgtactttgaaaaaactaacgatgactagcttaaaaactatccttaagtagaagtgctgaactgtgaatacgggttcttactattctgctcatttgcagacaataattccttaaaatttatcaactcccagtataacaagctttccccccactgtcaacgaacaaggcaaacaggaaaacaattttccattaaaataaatattgattgcagatttctccgcaatcaatacttgcttataaaccaacttcctgaaggctgtcagacaaacgtgcgaagtcagccatggaaagtgcttcgccacgaacactggcttccagctctgccatgccaagtgcctgcgtcagcttgtccttgacttcttcggatttgccgaaatggttggtcaggttgttccacagggtcttgcggcgatgcacaaagctggccttggacactcggaagaaaaaatcttcgtctttgacgctcaccagaggttgctcgcggcggaccattttgagaatggcggagtccacgtttggtgcaggcacaaagacggtgcgaggcacgataaaggccaccttggcagtcatgtagtactggaccgcaatggacaggcttccgtaagccttggtgtttggctcagcagaaatgcggtcggccacctcccgctgcatcatgaccacgaactcgctgaagggaatcttgctctcaatcaggtgcatgaggatagaggtggtgatgtagtagggcaggttggccacgaccttgatgggcaaatcagggttcttaaagttctgaatctgggtctgcaggtcggtcttgaggatgtcttggttgaccacggtcacattgtcaaagcgacccaaggtgtccgccaaaatcggaatcaggcggtcgtcaatctcaaaagccaagacctcagcggcattctccgccaaaaactcggtcaaggccccgattccaggaccaatctcgatgacattgacatttcggtcaatctctgccgtgtccacaatcttctgtaaaatattggtatcagtcaaaaaattttgaccgaaggatttcttaaaggtaaacccgtggcgttcaaggacggcacgagtaacgtttttgtctgcaattctcatgtgtgttctttcttgttttttatttcgccatttcactcaatcgtgaaataacacttagttttctcatcgtcgctgtaatgtccagctgtttttctaaataattggtatttagttttttctttcgagcatctctcggaagatacatgtatagacattgacttcccagacgcaactcctcatcgccaaagtcttggtgcaataatttgtttaatttttcaccatttatctcatcattggtaaagaccaaatgaacacgagaaggatcatagccctcaccaaaagaattttcagcaactgcttgtgttaactccatctgatgtttgacaatgatcgctaactctgcacctattttttctttaatggtttgatggataagccgactgagttcttcatctaatatatctgtttcacaaacaacatttccgctttgaatataggtttggacagaagttaaaccagcttccgtcaaaatttccgccaagtaagacatcttgggaattttattcttgccaacaggggtaacacctcgaaggaggacgacttttttcatttgttaatccccctcacctataatgatcctttagcgacaggatgcacaaccgatcagcttccaccatataaatcaaccgattctccgcatcaattctccgagaccaggcaccttgataatcatacttcaaaggttctggtttggcaatgccttcaaaaggatgtcgctgcatatcctggataatcttattgattctcttcagtgttttcttatcctgaccctgccaataaagatagtcttcccaggcgtcgtctgtaaaatggattcccatgttagtccgcctctatcaggtttcgttcttgggtttgtcccgttttgactttagccataccacgtaggactttttgagacagataagtgttccgagcaacagcgagggtttcttgtaaactatcccactcactctttgagagtacaacaatatcttcctctggatttttattaaccacgaccaaaggttcaaactcgtcattgacctttttcatatagtcctttaagtgatttcgaaaatgggaatatacaatagcttccataagcaatacctctcatcatttctaggcttactatagcatagaaaaaaagagttgtcaaacttattgtacaactctttaacgattctccaccttccattcgccgtcttcaaaccagtaaaaattctccgtcagctgcggctgttcaaagatttccaacatggtttcaaaaccgtcagcaagttggagattcttcaattctgcacggtcaatccagaagacctcgccctcatcagaagattggataaaacctgaaaaataactggttttgtagcaaaataccagatagcgataatggtcagtaggatccgtccagttttgaatgccacagagttcgagattggataccgtcaagcccgtttcttccttgatttcacgaatgacggaggaaataattgactcatttggctcgacatggcccccagggaaagtcacaccaggccatttctttgaattcctatcctgaactaatacctgctgaccgtctgtaatcatgcacatattggttaggatgacttgctctgtcctactcatgctctctcacttcaacaacttcacataatcactcttggtcgcaaaaagatgaccaactcgaacttcatttttcactacgcgatagagggcgatgtagtcttttccaacgacatagcctcgggttagatgaggcgggtctatctgcttaccaaaacggttatcggcgttaaaaccacgttcaggaaaaatttgcaaactctctaatgcttcgacaatcatcccaattcgtcttttggcaatttcttctgagaactgttccgaaaaataggcgtaaataactgccaattccttctccactgctggagcaagtatcactgaataagactcaaattccatacttctctttgacactttctaggctgatcccgtgacctgcctcaatcgcctgttggttttcctggatttccttctgtaactgtaaaaacaactcttctctttccaactcttcttctgtcagaattggcaactcattttttacagcgatattttgcaagaagaggttaaaaccagcagtcaaatccagctggttcatagcaaatacttccttggctttttctaaaagtctggaatcagttttaaaatttacttgggcatctttatttatagttatcaatctagtccacctcctagttttctatattttaacacaaatagacaccgctagcaattttcaaaaaagcagaaatagtaatatttccgctctagattgcctatctccccaaatcatcaaaataatagagattcaaaaattcttcctcagtaactggacgttcaaaattgtaaaaccagcgatagacttccacggctagtccatcaaactctaccctgtcgtccatttcttgcacaccggcaatatgaaacaaacggctctgcttccaaataccatccgcattgacatagccatcttcaactaaactaagcaaatagtctgctagtttgttcttatcaacctgctcatcctcccaaacaaggacatcagccggcagcaagtaggtcacttcttcataagatgaataattttcataagaaggttcaaactcgtttttaaccaagcacttaacagcgtagaccctatccatgatagctctccatagcctcctcaacctccgccaaacttatcccaaacaattccaatcgtttgaggagttgtttgccgttgcagtagccgatgcggagcttctctcccagatactccctccgcttgcgactgtcgccacccataagcaaccctagccgaatcagggtcttctggctaatatcaaagttattttcatcatcgtaatgaccacgtacgcctgctagggccttttccaagtcttcaaagctggcgtgctcaatgcccaaggaccgcccttttgttttggacttgggggcagcctcgtcccgctgtaaaaaagcgtgtttgaccgtgggaatggcctgtataatgatttttcgaatccgctcgccattgtagtctgggtcagtaaagataatcacgccacgcaggtcatggagtttctcgatgcgttccaagtcatcgtctgatatggcagagcctctggtttcgtaggtatccacctcgtaaaaccgcttcaagtttgccgtgtcgtccttgccttcaacaacgaggacttcttgtatcttaattttctgagtcaattctgaacaaactccttgcattctcgtaggtcgcagccgccacttcttcgaccgactggttgcgaagctgggccagcatatccaccacatatctggtgtagccggtgcgattttcccgaccacgcttgggaacaggcgccaggtagggtgcgtccgtttcgaccaggattttttctaagggcaatgcttgcgccgcttcctgaagttcaacggcttttttgaaggtcaccactcccgagaaggagatgtgcatgcccaggtccatgaaagcttgagcctcctccagagtgccagagaaggaatgcatgatgcctccacgcggaccgacgccgacttccttgatgatctggtaagtatcttccaaagcatcgcgagtatgaaccacaaagggcaaatccaactgcttggccagctccatctgtcgcttgaaaacacgagcctggatttccttatccgccgtcatccagtagtaatccagtccaatctctcccagggcaatgaccttgggatgctggagggctttgagcagatagttttccacttcctcgtcataagtgccagcctctgtgggatgccagcccagtgtcagataaatttcagggtgctggtcagcaagctccatagccttgtcaatggttgcacggtcaaaaccgaccacattgtggagggtgacccccatctccttggcaaagtctaattcttcttggacccgaccgtcaaactgctctacgttgaggtgggtatgggtatcaaaaatttgtatcatcgttccatcactttctttcctactattgtaacatatttcagaagattcttatgagaagaaaaaaaccagcagactcgagtttctgctggcttctcttttcatcttcttatgctactgtaagaactttacgtcccttacggcgacgagcagctaacacgcgacggccgtttttagttgccatacggctacggaaaccgtgtttacgcgcgcgacggattttacttggttgaaaagtacgtttcacgatgaatacctcctcttagattcttgtattcgtttagccggctagttttgatcagttactaaacataccaaactattttatataaattctgttcgtttgtcaagctattctgccatacttttaggaaagaatcagaaaatcattgaaaaaagaggactagcctctttttaatcatgatttccttcaatatctacaacgacatatcggttcggctcgctaccttctgaataacttgtcaaaccatccattttagagataatgcggtggataattttacgttcgctacttgacatcggatctgtatggtaggcttcctgctctgccaaaacacgttctgccaatttttgtgcgtagccttgaagaacctctgcgcggtgttctacataatcattcacattgattgtgatatagaaattacgctcataacggttgtataagaagttctgagccaaaagttgcaaggctttcaaaacttttccgtgataaccgataacacgacctggttcattggtatccacttgaatattgattgtacggcgattatgacttgtatcaatacgcgcctcaacatccatatcatccagaatttcttgtacataagctgtcacttccgaaacaacttgttcaatatcatactggggctcaatcttaatatctaaatcagcaaaattatctgcttgattttctgagatgacttcttgatttacgtcttccttagcagatgttgttgcatctgtagtagttagtaaatcctctgaaagaatttcaatccgacctgtttcttccaaaatcgttgtcgcttctttttcatttttcaagatctgcgctttaatatcatcatcaagcgtttgaccagacttttcaaattctttcaccgctgcaacaacttttcctaggtcaatcgtagcctctgaaacgctttttactggttcattgaggtcattaatttcacttggaacgccacgaactgctttctgattagccttaacaaccgttgtttcattgatgacatcaatatccacaatcgctggctttttaccgaaaccaaggaaaccttttttctcacgcgcaaccacagtaatatgtgctttttttcgaggaatattcagctctaccaagccattctggatggcctcttcaacacttgctcctgtaaatttcatcttctctctcctagttttcctatttctttttctgtgcttttttctgtgcccgtcggatttttgcctgacgctctttttcagcatcaattttcgcttgacgctctgctattattttaaacggattattgaacaccaaggtttgagcaacctgataggcatttgacactgtccaatacaaagccaccccactagcagctgccacagcaaagaaaaagatcatcacgggcatgacataggtcataattgtcatagccatattcttctcaattgctgatttattggtcaaccatgagctgaggaatgtaaacactgcagctagaatcggcaaaataaagaacggatccggctccccaagatttaaccaaaggaagtgacctactttcaaggcttcaacacgtgtcagagcttgaaagagggccaaaaggattggcatttgaataaagagcggaatcatggacgctctcatgctgacgccattctctttgtagagagcttgcgttgcttcataaagctgctggcgactttccatatccgttcctggatactccgcttgcaactttttcagctgaggttgaagctcctgcatcttccgtgaggaattcatctgtatttggaacaacggcaacagaagggttcgaattaaaatggtaaaaagtataataccgattccaatttgaccgttgatagataggaactgaataatgctggcaaaccagtaaattaatctatcccacgcatctgtagattgactggtcactggccctgttccgcaggctgttaaaacaattagagatgctaccagtagacctgcccatttaactttctttttcaatcacaacaccttcctggtatagtttagctagtttcaaaacatggatgaggttttgcttcatttcttgataggacaattcctctacaccttttcgagcaatgataacaaagtcatctgctaccagttgatgttggcattcaattaagatgtgacgaatcctgcgcttaatcttatttcgcatgacagcgtttcccaattttttgctgacagataaacctactcggaaatgcttttgctctttaggtaatcggtagacaacaaacctccgattggcgacattgtttccttttgtaaaaatgtcattaaaatctcgttcacgcttgacacgatagctttttttcaaactgccactccatctttcaaaattacttctattataccacaaaattcaaaaaagccaataaacataccgtttataggctttttgcgttctgaatttcctctttggcacttttcaactggtctgcaatcgattcaaaacctgtcccgccaagggaatttctacgactaacagcaactttggaggacaaggcatcataaatatctgcttgaataagaggcgaaatagcctgataggtctcaaatgatacatcctggagatagtgtcctgccttgctacactccaagaccagttttccaacaatctcatgcgcttggcggaagggcagacctttactagccaaataatcagccaactctgtagcatttgaaaagtccttctctgtcgattgagccatcctttccttatgaaccgtcatcgttttcagcatacccgccaaaatatcaattgaaatcaaaactgtttctgccgtgtcaaacatgccttccttgtcttcctgtaagtctttattataggttaaaggcagggatttcatgactgtcagtaggccaactaagttcccataaactctacctgttttcccccgaatcagctcagccatatctggatttttcttctgaggcatgatggaagaacctgttgaaaaggtatcggatagggtgacaaattggtattcatatgaacaccagttaatgatttcttcacacaaacgcgacatgtgcatcatgaggatactggcatttgacagaaattccaagataaaatcacggtcagacacagcatcaagagaattactatagggcttggcaaatcccatcaaatcagacgtcatctgacggtcaatcggaaaggtcgtccctgccaaggccgccgcaccaagtggggatacatttgtatgctgcatgttgaatgcaaagcgctcactgtctcggctgaacatgttgtaataggctaacaagtgctgagcaaaactaatgggctgggcatgttgcaagtgggtatagccgggcatgattgtttccacatgctcctgtgcaaggtctactaaaatctgacgtaggttggtcaatttgtctacaacttgaaagagtgtatccttcaaataaaggtgcatatccgtagccacttggtcgttacgagaacgagctgtatggagtttgcctgcaactgagcctattttctccgtcaatagactttcaatattcatgtgaatgtcttcgtttcgaatatcaaataccagcttgccagcctcatactcctctagcaattcttccagaccagcttgaatgacctgagcctcagcttgagagataatcctagtttgccccagcatcttgacatgggccagtgagccttgaatatcatacttggccaatttttggtcaaagcgaatggaggctccgaattcttcaacccattcctcaagactggcttcaaagcgacctccccataatttctttgcttccataggctcctactttctagctctttttatgaatttccgcattgaccttggttggcaatccccaaagcttgatgaaaccgactgccgcatcttgatcaaaggtatctgcactggtataggttgccaaatcttcgtcataaagggaatttggagatttccgagcaactactttggctgaccccttatacaatttcacttttgcggtgccattaacaactgcctgggtctgagcaagataggccttcaaggcatctgttgctggattgaaccacaaaccattgtaaatcaagttagagagttcatttgaaacaatcggtttgaaatgcgatacttcccgtaccagggtcaaatcttcaatttccttgtgggctgtcagaagggtaatagctcctgggcactcgtaaatttcccgtgacttgattccgactaaacgattttccacgtggtcaatccgacccacaccatgtttaccagcaatgacattgagtctttgaatgagattagcaagacttaacttttcaccatttacagcaacaggaatacctgctttaaactcaatatcgacatactcgggagtatctggtgcattttctggagaagtagtgatgccaaaagtatcttctggcgcttcattccatggattttccaagacaccacactcattggcacgaccccagaggttttggtcgactgagtaaggactgtccagatcggcaggaactggaacaccattttccttggcgaagatgatttcttcttcacgcgcccacttccattcacggacaggagccacgactttcaagcttggatccagggctgcaatggctacctcaaaccgcacctggtcatttcccttaccagtacagccgtgggcgatagtggttgctcctgtcttatgagccatttccaccaactttttggaaatcaagggacggctgagagccgataccagcggatatttttgctcatagtaggcatgggcttgtagggcaggcaaaacgtattcttgagcaaattcttctttcacatccaaaacatgcgattcaattgcaccgatggaaagggccttgtcatgaataaattcgagatttttcccttcaccaacatccatacaaaccgcaatgacatcatagtctttcttcaaccaagcaatcgcaactgaagtatcaagtccaccagaataggccaaaattaatttttcttttgtcataaactttctcatttctatatatattagcaaataaaacttagtgactattatagtgtatatttatacttttttgcaacatatttatgcaaattttcttaaaaaatgaataaatatcgtacatttccagaaaaatttccaaaaaaagctagagaatattctccagcttctaaaatatattcctcatcataactgattatggttgataaattttccgttcttttaaaattttccagaaataataagctaaactaaaatcaagcaatccatgaatagccgagccaacacccaccaagccaagcatcgttatccagtaggtagcagaagtttgttgccccgaagtaagcaccatcaccacaatatattctcctagaccatgcaggagattaagcccaattcctaatagtaaaaagcgcttagaatccatgagaatcggaaaacgcttgaccaagaccgcacctaaggtaaggaagaacaggtgcgtaagcgcccgaaatacaataacgattggaaaaccggcgaggaaaaagcctaaactagaacctaaagcaacaaaaatagcagtagctggtgaaataaacatggctataaacaaaggaatgtgactagcaagtgtataggatgctgggccaataatgattttaatcggcatcattaaaggtattaaaatggcaaatgcggttaaaattgcactaattgatagctgcttaactgaatttttagatgatagtgttaattgggacattaggcacctctctttctattggtttgattataaaacaaaaccttacaggtgtcaagacgcctgtaagatttattaattttctagtaaaatacctgcatgttttaaagctgctgaaagttcattataggcttgcacagatgggaaagagactgtatgtgtatgaactccttctgttaaattactcagtaacacaccttggtattgacctaaggcatccaaaaaatgatccctatcttctaaacttgcaatattcagcttgcctgataataagccgtaaatgggatgctcaatttcaacatctagtatttgagctccaccctctagcaagattgtcaattctttttctacctcttctggaccatgttgacaagctatctttcgaatgtaggctccttcagtagatggcaaagaagattggagtaagtaccctctcggagttgccaagacagcttctccctccgcacgaagcaaggctacatctccaacaattacttgtcgactcactccaaattctttcgccagataattagctgcaaggggataggggctttctcgtaaaagggataggattttcttacgtcgttctgttgctttcatacacattcctttcgtacacttttttccattatatcaaaattcctgtaaatcaacctttcctcaacccaaaaacggaaactgcagaacagtctccgttatcatctgctagtttagcaatgcttgaatagccgcaatgtccaaacgtttcatggtcatcacagccgcattgactgccttgaccttttctgggttagccgtatcgtatgcttccatcaaaatacgcggcacgatctgccaagaaatcccaaactggtccttggcccaaccgcaaatctccgcttctggaactgccgacactttttcataccagctctccgcttcttcctgactgtctacatagaccatgaatgagaaggcttcgttgaaagaagccacgccaccgtagccgtggtccataacaatcattttctgtccagcgacaagaagttccgcataattcagtttggcagcctcaacagcagcctccccttcaccgtagtaggaaagttgaccgacactagcctgagggagcttgtccttgtagtagtccaacataggctgggccaaaccgacctgttcctgcgagaagagcaggcagatgtcaaactgataaggcttgtccaagtccggtgcataagacagttgccaagacagaccaaagcggtcttccaaccagacatagtaagggctgaaaggatattctcccaaaggcatgagaatacgaccgccttctgacaaggcttggtacaaacgtgtcacttcatccttgtcggctacattgaccataagggacatggactcattgagcgtaaagtatggacccgcactaatagccgccaaggtcatatcccccagttgaaactgaatcaaatccgaatcaccagaaggcgtatccgtaatcgtgtaggtccagtcaacattgccaccaaagaggtccacataaaaagccaccgcttcttttgcctctgtatcataccagagatgaggaataataggttgcataaatttctccttttctttcgtctgcccattataccacacacttgtccgtacaagctcacaggaaaacttcctatgctataatagaaggatagaaaaggagcaagctatggaaatctggaatgcctacacagccgacggtcacttgaccgaccacaccctcacacgcggagaatccattcccgacggcctctaccacctagtcgtcgagtgcatcatccgccaccacgacggcagcaccctcttcatgaaacgcgacagcaccaaaccctcctaccctgactattatgaagcgacagcaggaggttcggctttgtttggagaaatagcagagcaggccattttgcgcgaagtccgcgaagagacaggcattgagctgacagctgaccaactacgccaccataaacactttgttgcccatgacgaccagtgcattttccactgctactgggctgaaaccgactgggacaaagttgctatccaactccaagccaacgaaaccagcaattatatctgggtgcaacaagaaaatttgaaagatttcctggaaacagagctagtcattccaaggcagaaagactatgtggagaggctgtttttagaaagctaaattcccctaacagacaaatccccgccgtcacaggacagcggggctccttttatttcaaacctgcaactaggtcagcaatatcggctggtcgggttcggcaacaacctccaactaccttggcacccagttcgtgccattcaagtgtgttgtccagaagagaatggctgtcgtctgccttttccttccaagtttgagtggctccatcatagacttccccagaattcggataggtgacaaatggtttatccgttttttctctcaactgactgagaaaggctggatagagcgagggagccgtacagttaagaccaaccgccaaaatctgctcactgctgttgaccagctctgctattttttcaatagacgttccgtcagaaatcgactgaccgtcttgtgaggtgaaactaatataggcttcagcctctggaaaatcctctgccagcaactctactaaggcttgtgcttcaagaacatttgggatggtttccaaggctaagagttcagcctcctgttctaagaggagttcaattctgcgacggtggaaatcttttaattctgacagactaatgttgccataatcgcctgtatattcagcaccgttcgccaaataggctgcgtagggacccacgtcacctgagatgagaggataggttcgttgtactttttcagcttcagacaattctgcccaaacctcatcacgcgcttccttggccaaatcaacggtccagcgaatgagttcttcagcctctgcttgtgacaaaccaacttctgctaatccttcaaaggttgcctgataggttgaagtcgtgaccaagtctgctccggcacgaatataatccttgtggatatccttgatatactggggattctccaaaagatacttggctgaccagagcttacctgatacatcatgacctcgaaattccaattccgtcccaagagcaccgtgtaaaatgatgtattccttttgttctaatagttctttaaaacgacccatactagtttctccttaccacttcttgaagcggatgtagtgataaatatagcagccaatcatgaatggcacaccaaagtaaagaccggcacgctgagaaggatcccaaccgattccgatgatggaaataaccaacaaaacaaccgtaatccacggcaaggttggtgagaagggtgtcttgtattccaattcatcttcgctatgattcttcaaaaattcacgtcggaaaccgatttgtgccaatggaatggccaaccaagcaatcacaactgcaaaaccagcaatggaaaccagagcaaggaagatagtatcttctgcataaattgacgcaaccaaggcaatcacaacaccaatcatggacaagatcatgccacgcattggaacaccgtgtttattaatttttaccaattccttgctaatcatgccttcatttgccaaagaccaaagcatacggcttgaagcgtatagccctgatgtagaggccgataaaatagccgtcaagataataaagttcataatatctgcagcgtaaggaaaaccgattttatccaatacaagtacgaatggcgcttctgtcacacctgcttctgacataggaagtagggctgccaagactacaatggtcaagacgaagaagatgaccaagagaccgattgttgacttgatggcttgtggcacggctttcttaggattgtcagtctctccagcggcaattccgatcatttccacacctgaaaaggcatagttaaccgacagcataactgaaatcaacccaactaggccgttaggaagtaaaccttgggctgtaatattagtaaagagcggcgcagcattggttccctcaaatggcaaaataccaaaaatagctaaagtcccaagcacaataaaggctgctatggcatagaccttgatagacgagagtgcatcctccgccttggcaaaccaaccaacagaaagggtatttagcccaaagacaataactgcaaaaatcgtcgcaaaaatccaaatcggtacactaggaaaccagcgttgcataagctgtgctgctccaacgaactgagaagctagagcgactacccaacaaagccaatacatccaggccaccataaatcctgttccaggactgataaacttggtcgcataggtatgaaaagaacctgtgactggcatggctaccgaaagctcacccaaagaaaacataaccaaatagaccataacagctccgaaaagataggctgcaacagctccaaatggaccagcctgtgcaatggtatagcctgaactcaaaaacaatcctgtcccgataaccccgccgatggacaacatctgcaaatgacgactgttcatctcgcggttaaaggtcccttgattttcaaaattatgattttccataaactctcctaaattcttgtgattattctatcataccatggattttcaaaaactggttatatcgttttcaatccaggtgttatagcttcaaactatgacaaatccccaccgccatatgacagtggggattatttcattacaaactcttcaacatattgtcaatatgctggatggatttttcacggccgagcaggtaaatagtatttggcaactcaggtccatgcatttcgcctgaaacagcgatacggattggcatgaagaggtttttgcccttgatgcctgtttctttttgaacagccttgatttgtgggaagatgttatctggttggaaatcttcgtccgtcatggcttccaatttttccttgagggcgttgagaacagttggaaccgtttcgcctgccatgacttctttttcttccgcagtcaattctgggaaatcagagaagaaaaggtctgtcaaaccaacgatttcatccgcagatgacatctgtggcttgtaaagttccaccaatttttctgccttgtctgtcaaacgccccgcttcttccaagaatggcttagcaaggttgaaaatagtttctaaatcagcatttttgatgtactcattgctcatccagtccattttcttctggtcaaaggcagcgggtgacttgctgagacggttctcatcgaagagttggataaattgctcacgagagaagatttcctcttcaccacccgggttccaacccaaaagaccgataaagttgaagacagcctcaggcatgtaacctttacggcggtaatcttcgatgaactgaagggtgttagtatcacgtttagacaactttttacctgtttcagaattgataataagcgtcatgtgaccaaattctggcgcttcccaaccaagtgcttcatagaccatgagctgcttgggtgtgttggcaatgtggtcatccccacggataacgtgcgagattttcatgagataatcatcaatgaccacggcaaagttgtaggttgggtagccgtcacgtttctggataacccagtcaccaccgatgttgccaccttcaaactcgatctcacccttaactatgtcgttccacttgtagataccagcttcgttgacagccaagcggaccgttgggacaatgccagccgcctcacgctctgcgatgtaggcagttttttcatcctcagacataccaaggtattcgttgatgtagcgaggtgtttcgcccgcagcttcctgacgctcacgctccgccgccaactcttcttcggtcacataagacttgtaggccttgccttctgccaagagctgatcaacatacttttggtaaatatccaaacgctcagactgacggtagttctcatgggtttctggactctcatcccagtcaatacccaaccaacgcaggttttcaagttgagaacgctcgccgtcttccacatggcgcttgcggtctgtatcctcgatacgaatgaggaaagtaccgccatgatgacgggcaaaaagatagttaaacaatgctgtacgggcatttccgatatgcaaaagtcccgttggacttggtgcgtaacgcacacgaattggtttagtcatgtttctctcctgtaaaatttcaatcaagaacattatagcatagatatgcataagaaaacagaaaaatcagtctaaacagactgattttgaggtgttttttggttacgtgccagccagtagaagacatagaggactaacaaaccagttgcagctaggaaaagtccgctaatctgattgacagtcaagattaagaccaaacccgaaaccaacagtcgagtaaaggcttgacctagcataaaataggttgataccgctccgccaatggtcgccaactgctcctctggcatagaattgacaaacttagcgttaaacttaggtccactagctccagaactaattcccattgtagtaaggaagaagaaaataattggcagttgatgaagcaacattccgacaaaaacgccaagaagagagaaagtggctgccacttccagcgtcaccatgctggtatttttgaaaagggtaaagactaaggtcgagcccagaatatgtccgataaagaagatcagaatggtcagggcaagggttgtttcaacattgaggaagacgaggcctgggtcttcgctaatcagcaggaccagaataggatagagaatcgctccacaggcgttgataagagggttggtaatcaggaccaggcggaactcgggtatcttgcgcagctccacgattgcttgcttgaaagaagctagaatgcctggtcccttggtttttggctcagtctggttcggctgctccgctattttcaaaggctgctccgtcaggagtttgcgaaaggctggcgtcagcagctgcatgatgagaagggaggctaaaaaggtgccggcgttgagaaaggccaggttttggtaggagaggaggccgaccaagagggcagagagggcctgaaaggcgatgttgaggaggctggtcacggtctggcgaaaggccgagtactgctcccgctcttctttgggcgctacgcgtaatcccagaggtgtatagaggccgttttcatagaagccagcgaagtctgcaaagacattgaagctagctgccactacgacaatccagagggctggctcaaagcccatgcagaatccgaggatgaggtagagaaggacacgaaagagtaaggtcagcttgatggtgctgattttattgaccgtcttgtctgctagatagcccgtaaagagccccataaagctagggaagatttccgagaaggtcacgatcgccagagccagacgactgttgggcaccagtaaaacatagttcatcaatgccagataatagaccacatcgccaaaattggacaacatatccgcagtcagtacccataggtaagtagcatttttcaaaatctttttcatgataatccctttcttttgattaattttcagaatattctgattttttgtcctacagaggagcctggatagaccttcctctgcgattattcttttacatagagtaaatatttaatgtagaaaatgccatatcacccgtcaccaagagaatcttttcttttggctcagatgcgtagttgttagttgttgacatggcgctatccaactctacaaccgcttgccagtcagcaggcagatagagtgtgatatttgagaaggccgcatcgatatgaaaatctgccttattacccagaatcaccgcctgatcaaaatagactgtactagatccaaaggctacatccacactatcatggataaaattttcctcatggatgtatcgagtcgaggaaccaaaagctgtatcgcgtcccttatcgccaatcacccctgtgacaactccatgagccagtctgcgcttccttggtttaaaaattagtttcaagccaagacagagtaagacaagcgacagaaacatgttccaagtcccaaactccacccattcatagacagagttggcagctataaaagctaggccgaaacaaaagatactggcaagccaatccaactttaccaagcggtgaaaacctgtcacaaaggttaatacaaaccagacagtggtccaaaagggcattgccaaatgcaaacccaatgactccctcaacaagaccaaaaccgccagtcctataactgcagctccaattaataaacgtttcatcttcctacctcatttcctgtaacttttcttttaataaatgataataatgccgcgacacgtggacttccttgtgagtcttatagaaggaaatccgactggtgcccgagaaggacttatttagcgaatagactaacttgctattgacaatggttgacttagctaccctacaaaagtagatgggcaaatgctcctcaagttcatagagtttcatcttaacctcgtaggcatcatcgcctgtatgagcaaaaatcttggttccatccgtttcaaagaaaagtatgtcccccaatgaaagaaaatactcgctgctccccttgtaaaaaacaagcgagggacgactaacttgttgcaaagcttgctgaatctgttcaatctctggtcccagctggctggttcggataacaacttcaacctgatctaagctgtcatcaaattcaatcctaactttcatagctccctcctttttgatagctctattataccagttcgacatccaattacaagggcatttcagtaagtggcaaaattagacaggtaagtggtagaaataaactaagaaaagtcccttgcattacgcgagggactttatttttattatatgattttgaaaattgcagagtttttcttcttaaaaaatcgcatccagcaacgatgtgcttccaccaccaccatcaccacctgcaccgacaatatgattgccaatgacctgagcaaaggtctcaatgttcaaactctgtacatagatttctccataaccagtaaaggtattaacgattccttcacctgtaccgatagattggaggaaaccattttccatatggatattgtagtccaaatcacgactccaagcaaccacatgagcattgtcaatggtgatacttccaccatccaaagttagcttcttaatagaaccaaacgcattcgccaaaagtgtgccatggccctctgtagtcatcacaaagagtccaccctgaccaccaaagaaagctttcccaacactctggcgttccattttatactgggcagaaccgtcaagggcaaggaaggcaccatcatttagtcgatattgctctgcaccaagttccaaggcaataacctgacctggcgttgaaggcgcaagtgcaatttttccatcgtcactattggaaatggcttgcgtgataaacatagattcgcctgataccattgaccgaccgatggcccccatcaatttaccaaaacctgaaccaccacgcgcattgagcttggtattcaaggtcacactcggcgtatggtagaccatgctcccctgttgaatataagctgattcaccagcttccaaggcgatttccaccaaaggaaactgcatattactatcgatagtatatttcatccgattgtctgacatagttgactcctattttttacgaaaggtcctgttaaccacaggatagccataataaacctagaacaagctaaaataaaccaagtatcatttatctcttcatttgttctgttgtgataatacaattttatctcattcaaaaaaacttgtcaaggatttcccggtcattcagataaaatttacaggaaaaaccgaacttcctgagcattcctatataacttctgttatacgacccgtatccacatcataaaccgcaccagaaatttcaacgtcgtcaggtatgagcggagattgtttcaagagagcaatatcctcccgcacgctttcttcaatgtctgtaaaaggaagaaagtcctgaccagccacatccactcccaaatctcgcttgagttggactgcaaattcttcattggtaaaggtctgtgcaccgcagtctgtatggtggaggacaacgatttcccatgtaccgagctgctgctgggaaatgactagcgagcgaatcatgtcttctgtcacgcgcccacccgcattccgcagaatgtgagcatcccccagagccaagcctaaggcctgcgccacgtgaagccgtgagtccatacaggtcacgatagccaccttggtctttggacgaagaggcaaatggtaatcaccatgcaggtcaacataggccttgttggccttcataaagttttgaaaataagacataggacctccttgtctgatgagaatttctgaaattttcagaaataggttagacctagcttatcacattcccgactatttgtcgcaaaaagaggagcgactagctgtaactcccgaatgatttcatcagttgaatactttctgcaagacttcgccaatggtggtcacgccgataacggtgatttccttgggcaccttgatacctgtcagggaatttttgggggcatagaccttggtaaagcccaatttggcggcttcgttaatccgttgttcaatacgattgacgcggcggatttcccctgtcagaccgatttcgcccataaagcactcttgtgggttggttggcttgtccttgtaactggaagcaagggcaactgcgactgccaggtcaatagctggctcatccagtttgacaccgcctgctgatttgaggtaggcgtcttggttttggagcagcaggcctgcccgtttttccaaaaccgccataatcaagctagcacggttgaaatccagtcctgtcgtggtccgcttggcattgccaaacatagtcggcgtcaccagagcctgcacttccgcaaggattgggcgggtaccctccatggtcacgacaatagccgagccagtcgctccgtccagacgctcttccagaaagacctcacttggattgaggacttcgaccaagccctgcgactgcatttcaaaaatgccgatttcattggtggagccgaagcgatttttgaccgcccgcaagatacggaaggtgtgctgccgctcgccttcaaaatagagaacggtgtctaccatgtgctccaaggtccgcggtccagccaaggttccttccttggtcatgtggccgacgataaaggttgcgatattgttggtcttggcaatctgcatgagctcattggtcacttcacgtacctgactgacagagccttgcacgctggagatgtcaggactcataatggtctggatagagtcgataatcaggaaatctggcttgattttctcaatctcggtccgaatgctctgcatattggtctctgcatagagatagaactcgctgtcaatgtcgcccaagcgttccgctcgcaacttaatctgctgggcagactcttcccccgacacatagaggacggtgccaatggtagacagctgagtggatacttgcaggagcaaggtggacttgccaatccctggatcgccgccaatgagaactagactccccggtaccacaccgccaccgaggacgcggttgaactcctccatgttagtcttagtgcgagccacttgaatggatgacacttcattgagtttcatgggacgggtcttctcacctgtcaggctgacccgctcgttcttgacttcagcgacttccacttcctcgacaaagctagaccaggagccacagttggggcaacgacccaggtacttgggcgagtggtactcgcaggattgacagacaaaggttgtttttttcttagcgatggtcatttcctcctatagagtgtattctaggatttcgcagtaggctatagtttctttgggaacaaactggcgtatcagcataccgtgacagacgataacgattcggtcataggctttgtattttccaagggcctgtaaaaatcgctctctcatctccgcagcagtctcatagcgaacaggtgaagactcaggcaccgctccgctattttccaaaaataatcgatgagctaagacagcctcgtcttgactggcattttgccccgtcatatctggtcgccattcatgaaaaaagggctcgaccataagaggtagttgctgggcatgagcaatgtaggtcgcagtttccaaggcccgtgtgacgcttgaagcgacgactacttgagcttgggaaaagataggattactagcaatttcctgagctaaagtccgccccttttcagttaaaggagccaaatcccgtccaaaacctgcatacagccgaggattatcatgctggtcaaacatactgtagtcgggttcggaatgccgcacaaagagaatctgcatagtagtctatttccctgtcgatccaaatccgcccgtccgaacgccgtcggcctgatcaccgtcagccaagaggaagggggcaaaaacagcctgcacaatccgctcaccagcttccaccacgacggtttcctctgtgatgtttcgcatctgggcaaagatgtggccttcgttggctggattgccgtagtagtccccgtcgataaccccaaccgagttaatcaggaccagacccttcttgcgaggattggacgagcggtcgtagagatagaggacttcgtttgcctgcatataggcctttacacctgtcggcaccagcttaatctcgcctggctccaagctgacagtttctgcagctttcaggtcataacctgctgcatgagcggtctcacgttttggcaataagttttcatcagtaaactggctgaccagttcgaatccacggattttcatagtagtttcccttcaatttcttcatgcataatacatacgctctctattataatttattcgcaggctaaaagcaaaactccaacctagtggctggggttttcaactttattcaaacacaaactggttgtggtaaagttcggcgtagaagccatttagtttgagaagttggctgtggttgccttgctcgataacctttccatccttgaggacgatgatttcatccgcattgagaatggttttgaggcggtgggcaatgacgaagctagtccgtcctgcgataatggcctccatagccttttgaattttggcctccgttacggtatcaacgtttgaggttgcttcgtccaaaatcaagacttgtgggtctgtcaaaagcgtacgggcaatggaaatcaactgtttctgacctgttgagaagacattctcatcatcggtcacaaaggtttcatagccctctggcaagctcatgatgaagtcgtggatatgggtggcacgagctgcggtttccaccatttcctgcgaaatgctctcatcaccaaagcgaatattgtccgcaatagtacccgagaataacaccgactcctgcaagacgataccgaccttattccgcaagctatccaaatcatattcccgaatatcgcgaccatcaaaggccacactaccaccattgacatcgtagaagcggttaatcaagttcataatggtagtcttaccagatcccgtcggaccaacgaccgccaccatcttacccttaggagcagagatagacaccttgtccaagaccttctgacctggcaagtagccaaagtcgatgtccttaatttcaacaccttcttttaattcggtaaatagcggagcgttttgaggacgaacttcctcaggctcatcaaacatttcctgaatacgatgagctcctgtgaaagctagctgcaattctgcccagctggcagcaacctgcatgattggctggtaatactgttgcgagtattgaacaaaagtcaccaccagaccaagtgcggcagctgtttccagtgagctgtcattgagaacaatgctggaacctgcaaagataacaatggccgtattgaccaaactcataccattcataaatgggaagagaatcccaccaaacaagcgtcccttgaaagttgtgcgacgaacttcttcattgagctccaagaaaccatcaattgtctcttcctgcacaccttgtacaataatcgctttttgtccagaaattttctcgtccatgtaggcattgagtttagacaccgcagcctgttgcttatccgtatatttccgtgataggcggatgataacgaccaaggcaatcaaggcaactggcgtagaagcaatggtcaccaaggccaagcgagtatcctgacggaacatcatgatgaccataccaacataaagagcgatgttggtcaccacttgggtcaaggactggttgaaagcgttttggatattgtccaaatcactggtaaagcgagaaagtatatccccgtccttgtggctatcaaagaaggcaactgtcaagcgttccagtttgccaaacaagcccttacgcatacggttggtcgaatgagccacgatacgcgtgaagaggagagtgtaaatcaaggaagccacaaccgtcgccgcataggcaaagaaaagattgagcataaccccgttaaaatcagccatgtctggctgaaagtcagcctgaccagcttgattggccataaagtaagcctgcccgattttccccatctccgcaatggcatttccaaggaaaacaggtgtcttaacctgcaggtaggtcgctgccacaatggctagaaaaatcacagcaaaggacagtttatagcgtttaaaataaaaccagaaaaaacgtaacgtcttcatctattcctccctccctttctgtgtttcgtagatttcacggtaaacatcgttcgtcgctaccaactcagcgtgagttccttgtccaattagacggccttcgtcaagaaccaaaatcttatcagctttgacaacagaagaaatcttctgggcaacgatgacagtggttgtccccttcaaatcatggttgagagcctcttggaccagtttctcagacttggcatccagggcagaagtcgagtcatccaagaccaaaaccttaggctcaccaatcaccccacgagcaatggacatccgctgcttctggccaccagagaagttatttccacgttcttctacttggctctcataggtatcatccaagcggtcgataaattctttggcttgggcaatacctgcggcccgctccaagcgttgcaaatcagcaccaggtgccccttgacgcaggttgtccgcaatggttcccgagaagagaatagccttttgcaagacaatcgataccgtatcacgcagggtgttcttgctgacttctttcaagtcccgaccaccgatggacaccgttccttcttgcgggtcaaacaaacgcggaatcagttgagcaagagtggatttacccgcacctgttgcaccaaccacaccgaccatttgacctggctcaatctcaaatgagatatttttcaaagtcggctccgtatcgtgtggataggtaaagctaacattgtcaaaaacaatcttaccagtcaattcttcatccgccacatccttgaaggtcatagcaggttctgtatccaagacctcgctgatccgcttaatagaaatagcagcacgtgaagcctgcatccccatgaagctagtcatgataatggcaaacatgatttgcatgaggtaactcataaaggaagtaaagccaccgactgcctccaagttggtttccaacatcccggacaccaagtagagcgatgcaaaaatcgccatgtaagagataaacatcatcaagggttgcaagatagcaaaaccatagccgataaagaggttgaggtccaagagttcattggatactttcttgaacttggcatactgatttttttcctgtacaaaagacttaaccacacgaatcccacggaggttttccttagcaatactgttcatcttgtccatgagggactggaatttcccaaaacgtggtcccatttgccccatgacaactgccataatagccataatcaagaccaccatgagaataatcatccaccagagttctggcatggtccgcactgccatgataaaggctccgacaaacagcaatggaacccgcatcaacactgtaaagagcatcatgacaaggttctggatttgattgacatcgttagtcatccgaacaaccaggttccctgcgttaaactcttcgatattagcataagagaagctttggatcttccgaaaggtcttctcacgaatatctgcagataccccttgtgaaatttttgctgcagcaatggtattgacaagccctgccaaaagaccaattccagcaataatcagcagtaatttgcccacacgaacaatttcatccttgtcattggccaagactgctgtcaaaacatcctgcaaataactaggttgcatcaaggtcgttgctacgacaattgacgtcagcaagaccgatgccaaggcgtaccatttataacgtaaaatggcttctttaaacatgattcttctccttatagcgttgaatatttacttttaattgattgcccacctgtttaaccaagtcaaagtcctctttttgaatgccccaaaaaagtgaatggtgcatttcttcatgaaaagctttcaggtgacatatcttcccttgtcccttctctgtcaaaaccagctgtttgaagcgtttgtcaaccttagagggaaggacttggataaagccatttttctccattctcttgaccagattgctggcaaccgatttggaaatctttaattccgcttctatatcttttacaaaggtttcggcttccgaccgttccgcaatgaagcgcaaggcccagccctgtggaccagccaagtgctccacatcgtattcttttgcaatggtttcactaatttgttcaatctgattgagcaagttccgaaaatctgcaatagtatgtcccatgacagctcctttctacgaaaataattaccatgagaactattatagttctcttaagaactattgtcaattatttcgtttgctcttttctgaaaatattttgttatttcagcatcattacgcacttaaaacccataatatatataccgtataaattatataagattttatgtatcaattatggtataatatatctaaattacaccaactagaaaggattttttatgaccaaacaaaccattgccatcttgggacccggttcatggggcaccgccctaggacaagttctcaacgacaacggtcatactgtccgtatttggggaaatgtccctgaacaaatcgacgaaatcaataaagaacatacaaataagcgctatttcaaggatgttatcctagatgaaaacatcaaaggatataaggatttgagtgaagccttggacggtgttgacgcggttcttttcgttgtgccaaccaaggtaacacgcctagttgccaagcaagtcgcacaagctctcaaacacaaggtagttgtcatgcacgcttcaaaaggcttagagcctgatagtcacaagcgcttgtctgaggtactggaggaagaaattcctgctgaactccgttctgaaatcgtcgtggtttcagggccaagtcatgcagaagagactatcgtccgtgatttgaccttgatttctgcagcttcaaaagacttggaaacagccagctacgtccaaaatcttttcagcaaccactacttccgactttacacaaataatgatgtcatcggcgtagaaacagcaggtgcccttaaaaatattattgctgtcggtgccggcgctttacacggacttggttatggtgataatgccaaggcagctattatcgctcgcggtttgacagaaatcacacgtctaggcgttgctatgggcgcaaatcctctgacttacagcggtctttctggtgttggtgatttaattgttaccggtacatctgtccactcccgcaactggagagctggagatcagctcggtcgcggtgaaaaactcgaagatgtagaacgcaatatggggatggtgattgaaggtatttcaacaactaaagcagcctatgaattggcacaggaattgggcgtttacatgcctattactcaagccatctacaaggtcatctaccaaggtgcaggtattgaagatgccatcaaagaaatcatgacgggtgaattccgacatgaaaatgaatggcattgatttttattaaacagaaaaaataaaattaaaaggattacatacttatgaaaaaagttagaaaagccgttatccctgcagcaggtttgggaacacgtttcttgcctgccactaaggctcttgccaaagaaatgttgccgattgttgataaaccaactattcaatttatcgttgaagaagctctacgatctggtatcgaagatattttggtggtcactggtaaatcaaaacgttctatcgaagaccactttgattcaaactttgaattggaatacaacctcaaagaaaaaggcaaaaatgatttgttgaaacttgttgatgagacaacaggcattcgactacacttcattcgtcaaagccatccacgtggacttggtgatgccgttcttcaagctaaagcatttgtcgggaacgagccatttgttgtcatgctgggcgatgacctcatggacatcacagatacaaaagctgtcccattgactaagcaactcatgaacgactatgaaaaaacacatgcttcaaccattgctgttatgcccgttcctcatgaagaagtttctgcatacggtgttatcgctccacaaggtgaaggtgtcaacggtctctatagtgtggaaacctttgtggaaaaaccaaaaccagaagacgctccttctgaccttgctattatcggacgctacttactcactcctgaaatctttgagattttagaaaaccaaaaaccaggtgccgggaacgagattcaattgacagatgctatcgatacactcaataaaacacaacgcgtgtttgctcgtgaattcaaaggcaaccgttacgatgttggggataagttcggtttcatgaaaacttctatcgactacgccctccaacaccctcaagtaaaagatgatttgaaacaatacttgatcgatcttggtaaaaaattagatacaaagaaaaactagcaagcgctagttttttcttatgtcaaataaaatatccctaataatagggcgatcagacccagatagccaatgaaactgaaaaaaatctgttttcctgtaaagagatctttttccacaagaggtggaaggaacatcacgaccaagcaacctccaacagctcctccaatatgtcctgccatactaatggttggattaaaaagtcctaagaccaagttcaatcctaaaaggaccatgtagcgttgaccaagaacctgtagataagggctgcgactaaatttcctcaaaagtgccatagccgcaaaaagaccaaagagcgaggtcgatgcacctgcaccaactacatctggtgtaaaaaagagaacaaaaagattgcccattatcccagacaagagatagaggagaaagaagcgccttgagccaaacagtccttctaattgataacccaaaccaagcaaagtaatgctgttaaagataaaatgctcccaaccaatgtggacaaagatgggggaaatcaaccgccacaactgagtcggatcataccgcacaacttgaccatacatgccaccaaattcaaaaattgtataggctgtagtggtctgcccaaatcgaaatacttgtatcaaaagaaaaacaagagccgtgactgccaacaagccattggtcacaggatagcgcttatcaaaaaagttcttcaaaaatcaacaactccttcactggaatatcaaaaacatctggttcgaaatcatagacttgaaagtctgccaaggtcgataccgtctccccctgataatctgctaggtagcgatcataaaaaccaccaccatagcccactcgaaaacccgcttgattccaagctaaaccaggcacatggagcaacttaaccacagacttatccacaggttgtgaataaataccaggttcccaaactccaaacctagatttcaccaaatcatcaggattatattctacaaaatccatacgtccttgtgaataggtcttagggatgaaaatctgcttgccgtccttttgagcctgttcaatcaggtaagaagtgtcaaactcatggggcatggaaaggtaggtcccaagcgactttgcaccctgataagtatcagaagcaaggaggcgttccgttaactgctgactccatcttgctcgctgactactagtcagatctttcaaactctgcaagacctcttgccgaatgctctttttatccacagaaactcctttcttttcagaaaaagactggaaaaccagtctagtttgctttcattttcaaaaaatcactcaacttatccacagcaaagggaagcacttcctccttgggactaaggcgaggattgtggaggggataaggcgtatccacacccagccagaacataacacccggcaccttgttgagcaggtagccgaagtcctcacccgtcatggcaggtggacagtcaatcatctccactccgtcaatgccatcaaagtaggtcatgagttcatccgccaactgaggattattttccacaggtagataaccgctaggattgagctcgatttccaagtctactccaaaggacagggcgattccctctgccacttcccgcacccgcttttgcaccagaagactcatgttctgggtcaaagcccgaatggtgccgtgcaaaaaagctgtttcagcaataacattattggtcgtgcccgcgtgcatggagccgaaggtgaccaccgctccctcaatcggatcaacgttacggctgaccaccgactgcacctgagtcacaaagtagctggctgccaccaaggcgtcatttgcggtatagggaaatgctgcgtgcccaccctttcctgtaaatcgtatcttgacttcacaggtcccagcaaagagggtcgcacggttggtggccatttgaccaactttgaggtccggtcggacatggagcccataaaattcatctggtaaccaatccccgaaagctcccgcttcatacataagcatgccacctgctagattttcctccgcaggctgaaacaagaagagaagattatttctcggctgctgctctgccattttctccaaaagccccaaggcaatggtcatgtggaaatcatgtccgcaggcgtgcatcctgtctgggtggagggacttgaagtccaggcccgtctcctccacgatcggcagaccgtcaatatccgcccgccagccaatcgttttctctggagcagagcctgtcagatagaccagaatccctgtcttccaagtgcggacttgggcaaaagaacagtcttgaagtaaaccttcaatagtttccataagaaaggcgtgggtcttgaactcctccatgcccagctctggaatctggtggagggcccggcgtgtcgcaatcaaatctagcatagctacctcttagagtgtccgcaaagcctcttccaaggctgttttttgttgggtttgagcgtcgatttccttgatgatgcgggctggcacacctgccaccactacgttttcaggaacatcttgagtcacaatggcacccgccgccactacagaaccgctaccgatttgcacgccctcgataacaacggcattggcaccgaccaaaacgttgtcgccgacacgaactggctcggcagaagctggctcgatgacacctgcaaggaccgcacctgcaccgatgtggctgtttttaccaacggtcgcacggccgcccaaaatcgcacccatatcaatcatggtacctggaccgatttccgcaccgatgttaatcaccgcgcccatcatgataacggcattatcgccaatggtcacttgatcgcggataatggcacctggctcgatacgggcattgatattacgcttgtccagcaaaggcacagccgaattgcggccgtcttgctccaccacatagtctacattttcagtcaagtttgccaagagtggctcgacatccttccagtcaccgaagaggacattgccaagctttgtcacttcagcaggaacagctcctgccaattctccttcaaaggtcactttaacagttgtcttcttcacagcattaccgataaaagcaatgatttcttgcgcagtcattttttgtgcagtcataatgtttccaatctaaaaataatattttttctattatatcaaaattttctgaaaatttgggaagaaatgcaaaaaaatgaaaaagggagtgggaaagaactcgattaggtcaaaaaagagttcgtcttcccaccctcgcacagttgattaggccagatttggagtgcaaaacacgaacaaatctgccaatcaaccactgcgctgagatgttgatacgaactctgagaagtgatcctgggctttttgcccagcctcctaaatactatagaactctctatcctcctaaagcagctgacatttgctctatctgctgttgcaaaccatctctatactctttcaagaatgtaataatctctgctcttccaacaattgcagcatttcctaatggaccatattgttttttctgttgctcaacagattgtgataccgtatcacgcacagactggtacatagtggcatcacccaatccatactggctgaccatattttcatagttcgtaatatattcattcacaatgaattcatacatcttcatataatcgctataagtttttatactttcaattgttgcatctgagctatctgtcggattaaattctgaaactgtagcagtactttctgaacttgttggggtttccgtagttttagaggaagattctactacctcatcactaatatctacgctatttaagatctgttcaaactcttgtttcctagtggaagaatagtcatcctttgacatataaattacatttaaaaatccctgttggagtgtcgactaaaaagagttgacctttatatgcttcgccatctatcgtacctgtcgcatcataaaggaagctgtccatcccatcaatcttagctgagctttcgttagctggtatcacttttcctgactgttccatccccttcagatattgggagcgaacagttgcatctttaactgattcctctaagggcaaccaatatgccattgccaatgatgaatcatcgggataaaaatataaggtatcactcgtatccccttctttactcttccatgattcatttatgctgatagccacttctgacaattggtaagttttgtatcttatagagcttgtacttacctgttctgtcgaagattggccaccgctagagctcgtaaggttcttaatcagaccaatcgcaaacaatccaaccaacacaataaaccaaattcgcttgtaaaatggtttcttttgcacatagacattcccatgttcatctctaattttcttcgccatataatcctccaaaaaattgtgtacaacaccattatatatatatgcgttgtcaagtagaaaaacaaaaaaattagaagttttacctcctaattttcatgtattatcttaatcttcaatttcttttctgggattgacagctcctacgatgtaatcctgtaccaagcctgtaccatccagcacgatcccatgcaaaactccgccgtaaacagctccaccgtcaatccccattttcccatctggactggtccagatttggctaatgcggagttttgtttgataaaggttataaacaggagtatgcccaaagacaatcatcttccctgtggtattttcggcctcatggaaaggggtgcgtaaccaaaccttatcatgattgctggtttcacgccagtctggtaaggtcaagtccacaccagcatggacaaagatataatcttccgtttccagatgatagggacaagatttgacgaaatcaatcaggtcctcatattgttccaacactgcattggcatccaccaatccatctacaggagcatccaagggccgaccaagaagggagttaatcgtcgtatcgccaccatttcgccgatagtggtcatagcggtcaatcggatcacgcaaccaggctagaaacattcgctcgtggttacccgtcagacaaattgcccccttttcccgcaccaagctccagaccaactccaaacaggctttggaattttctccgcgatcaatcaaatcacctaggaagatcaactgttgtcgcttctcgttccatttcttcaaaatatcgagtagcagttcaaactttccatggacatcgccgattacaaaaaattcttttttcatagactctattctaccacatttaataagcaaagaaaaactgaccgtttccgatcagtttggttttcttacaaacgtgcgttcaattctgcaccgagttcttcaaatcctggttttccaagaagagcgaacatgtttttcttgtaggcttctacacctggttggtcaaatgggttgattgcattgaggtaaccagagatcgcaattgccaactcgaagaagtagaaggtgtaaccaagtgtgaactcatcttgttgcggaagagtgacaaacatgtttggtacgccaccatctgtgtgggcaagaagtacgccgtccgttgcttttttgtttacaaagtcaacgtcttttccttgcaagtagccaagaccgtcaaggtcttctgccatttcaggaatcaagatattttttcttggtttatcaacacgaactactgtttcaaagatattgcggtttccttcttggataaattgtccaagtgagtgcaagtctgttgagaagttagcggatgttgggttgatacctttttggtccttaccttctgactcgcccgccaattgtttccaccactcgctgaagtattggagtgatggctcgtagttagccaagatttctgttacatagccttttctgtaaaggatgttacggacagctgcatattggtatgcttggttttcagcaatcttatcagatgtaaatgtcgtgcgggctgcgtttgcaccttccataagggcatcaatgtctgcaccagctgccgcgattggcaaaagaccaactgcagtcaagactgagaaacgaccgccgacatcatctggaactacaaaagtttcccaaccatttgcgtccgcttcaaccttaactgcaccttttgccttgtcagttgtcgcatagatacgcttgttggcttcttcttgaccgtatttcttgacaagtaattctttgaagacgcggaaggcaatagcaggttcagttgttgtacctgattttgaaatcacgttaactgagaaatccttatcagcaacataatccaccaagtcagcaagatagcttgatgagatagagtttccagcgtaaaggatttgtggagctttgcgctcttcacgtgtttgcaagtttacaaaggcattgctcaagaaatcaatagctgctttagcaccaaggtaagaaccaccgataccgataactaccaaaacttcactttcattttggattttagctgctgcttccttgatacgagcaaactcttctttgtcgtagttttctggcaaatccaaccagccgataaagtcgctaccaggacctgttccttgacggagcatttggtctgcaagggtaacttgtggttgcatgtattctacttcttgagctccaacgaattggcccaagacttttgaataatcaaatgtaatatgtgtcatgtttttcctccatttatgtaccataatatgataacgctttatcatatttttttcaagaaatttatcaattttcatttattttcatgaaatatgttgtataaatcttaatttttgtgaaaatctaacgaaattttcgcgtttgtaataatcctccaaagtctctcccgactgggttactgtaatccatttcgggagaatcttagatagtaggtaaagcggaatgagggcaggataccaaatgaacatgacttcaaagatgaaccggtcgttgttgcctcttgaaatgtaacgttggcggtattcttctttgagagaagggtggggaatatagatatgaaatggtacaccaccgcgtatagacatggccagcaacattctcatcagaaaattcagcgctactaggactgtctttccttgtctatgaagagtgtagcccttattgacatagattgttttatagcgtttatccttcagtgggcgtttggtggattttcgctcctctttcgttaaatgacgaacactgctattatcgtacttaatgtcagacatttctaagtccacaacatctgtatatttcttagcaagtgtcgtttttcccatacctggaaaggcaaataaaaacataggctttcctccttattcctcagtagaatagcagagcatccaaaaagttttcttaagttgcccctattttgcctctcatttctaaaaataagccaaagaaaaccctctgaaagcctgatttcaaagggttcttagattatacgcaaaaagagcacacactcgacctcgcttagggctgctggattcctcccctgacccgcttcacgcacgaatgttgctccatttaatattataacacaatttggccagagtgcaagtttggaatattaactagctatccgaagttgcttcctcttgcgtcttcatgataagtttagcagccttctgactttctctgcgttgtctgaaaaaatcttgcatgatattggcacattccgcttctaaaatacctgtttctaccttgacacgatggttgagccgctcatctgtcagaatgtcatagaggctacctgcagctccaaactttttgttggttgctccatagatgacctgcggaatgcgtgctaggccaatagctccgctacacatcacacaaggttcaatcgtcacaaaaagggtcgaatcaagcaagcgccaattcccctcaacattgttagcctcttggattgccataacctcagcgtgcatgattgcctgattgagttcctcacgcgcattatgccctctgccaataatctggccatccttgacaatcacacaaccaattggaatttcatccttttctagcgactttctagcttcttgcaatgcttgagtcataaaatactctttttcttcatgtgtatagttcataaatctattatagcacagccctgataacagttcaaaatcacttctttattcgctgctatcaaaatcaatctaacactacttcttccttatcacacatttctttcaaaattctgcccttctattaacttaaaaatataaaaatacctcctcagtcgagaaggtagggggagcaatattgatttttacagatattaatatatcatttattgtcgatattgtcaagaaaatttttaaaaaaattcaaaaacagcctcgaaaggctgtatctgacattttctattacaattcgccaactaatttcacaacattttctactgtgaagccgtagttgtcaataactgtttgggctggagctgaggcaccgaatgtgtcgataccaaggactttaccgtcaagaccgacatacttgtaccaactttgagttgcacccatttcaattgccaaacgacgacggatggcatttggaaggatttcttccttgtaagctgcgtcttgtgcatcgaagagttcagttgatggcacagaaaccacacgaaccttagtgcctgctgcttctaattctttggcagctttgacagccaagttcacttctgaaccagatgcaagaaggattgtatcaaagcctgctgcttcatagacaacataagccccttttgcaaccttgtcaaagtctgttccttcttcaactgtcaagttttgacgagtgagaacaagggctgatggtgtagacttgctagtcaatgacaagtaccaagctgcctgtgtttcacgcgcatctgctggacggaaaacgttgaggtttggcatagcacgaagtcctgccaagtgctcgattggttcgtgagttggtccatcttcaccaactgcgatagagtcatgagtgaagacataagtcacaggaagtccttgaagagctgacaaacgaactgctgcttttacatagtctgagaagacgaagaaggtaccaccatagacacgaagtccgccgtgggctgccataccattcaagatagttcccatggcaaattcacgcacaccgaactgaatattgcggttgagtggatttactgaatcttgcaaaccatcttccttgatgtaggtcatgtttgagtgagccaagtcagctgaaccaccgaggaaggttggcaagaccttagccgctgcgttaagcgcatcttgtgatgagttacgagttgcttgtgagaagccattctcataaactgggaagtcttctggcttgatttcaactacgtcacgaccttccaagatagctgttacttcagctgctaattctggatgagctactttgtagtcttcaactaatttcacccaagcatcgtaggctgctgcaccgcgatcagctacattagctttgaagtccgcatagacttcagctggaatttcaaatggaccatagttccaatcaagcgccttacgagttgcttctgtttcttctgcaccaagtggagcaccgtgaacggcatttgtaccttgtttgtttggcgaaccatgaccgataacagtcttgatttcgataagagatggcttaccagctacttttgccttttcaatagcagcaaagatggcatctacatctgtaccgtctgttacaaggtctgtatgccagccataagcattgtaacgggcacgtacatcttctgtgaaggagtcttttgtttcgccatccaagttgatgtcatttgaatcgtaaagaacgatgagtttttctaatttttgaagacctgcgtaagaagccgcttctgcagaaacaccctccatcaagtcgccatcaccacagattacgtaagtatagtggtcaaagattgggaaaccatcacggttgtacttagctgcaaggaaacgctctgcttgcgcaaaacctgtcgcagttgagataccttgtccaagaggacctgttgttgcatccacacctgctgtgtgaccgaattctgggtgacctggtgtttttgagccccactgacggaagtttttaatctcgtccatagtcacttcttcaaaacctgaaaggtgaagaagtccgtaaagcagcattgacccatgacctgctgataagataaagcggtcacggttcacccagtttggctgagcagggttgatacgaagttctttagtaaaaaggctgtaggccattggagccgcacccatgacgacacctgggtgacctgattttgatttttcgatggcatcaataccaaggaaacgaatcgcattgactgaaagatttgacatgtttttctccttttttaaagtcatgaatttattataccataaagcgttttctatgtctgtttgaatgaagcgagaaataaattgtccgtagaaaagaggcaggactttcgtcccgcccttggagtgaacagtagtaattcgcacatttcatactttatcagagtttatagtgcctctcctcgtctctatggggcaagagagttctaaatcttataataaagccttaaattgaatatttgagtcttctaagaagcaatcatcaaagccacgtgggtggtgatattcgatacggtccttgtccatcgggtaagtatacttgccaccaacttcccagatgaatggatggaaatcgtattgcaagcgttctttccgcattttccagagctgtaggatttcatctgttgacgccatgaagttagaccagatgtcgtagtgaacagggatgattaccttagcacgcaagttttctgccatccggagaaggtcgattgatgtcatcttgtcttggataccgattgggttgtcaccgtagttgttgatagcaacgtcgatgttgaagtcacgaccgtgttttgcaaaatagtttgagaagtgggagtctgcaccatggtagatagttccgccaggtgtttcaaagacatagttgactgccttgcgagccatgagttcatctgtcacaggaagtcctgctaatttaccaccattttcgtcataaccttcgatcggaagtgtcaccaagcaagtacggtcgaaggattctacagcgtggaccttgatgtctttaaactcaaagctatcgcctggtgcgatacggatgatacggtcagctggaaccccccatttttcccagatatcgccactttcaaccggtccgacaaatttcacatggtccaatttaggattgttgatgatggcagcggcagtgctgatatccatgtggtcgctgtggacgtgcgatactagatagtagtccaattcattgatggcaaatggatcgataaccattggctgcacacgcaagtttggttgcaatttgcgcacgccagccatgttagccatctggtgtccccaaaccatatctttcacttttttagtggattttccacgtgatgaccagaggtccatgaccacgttagctccacctggtgttttaatccagacaccacagtttccaagccaccacatagcaaagttgccctctggcactacttcttcttcgatttcttcattgagccaagttccccactctgggaaggttgaaagaatccaggattctcttgtaatatcttgaactttagccattttccattcctcctataaggtacgtttctatgcttctagtatatgctccaaaggcaacaaaaaaaagaccaaataaaacacaggcttgtgttcaaacttggactttaccctaatacagatctgtttcaatatcttgactggataaattggttaataattcattggtaatcagtttttgtagccgttgtttgagttctcgagcggtccttccgtctgcgatatatcccgatagaagcttgtctagttctactgcaaaaacttgtttttcatctgccaaactacgatattttgcaaaatgagtcatgtttagcacatcatcaaaatctaaaatggggtgaacctgcaccaaagggaaatcagtttccaacccatcgctggttgtaatcaagaaatcaacctctagtaagtcttcgacactcttgaattgttcagtggtaaagactgcgccaatcttcttatctggcaagtgatgctggcattgtttataaagtaagcgttggactgacaccccttcatcacagattaaatagacaatctgtgtctgtgccttgcgtgtcccactgcgtcgaatagctcctcctagatgaatcgtcaaataggcaatatctccatcggataactcaatctgccactcctcctccaaaatctttccagaaacccgtgtcatagcaaacagggtgctgtatttatcttggatttgttggaccattggatttttagataggatgccgtaggtttttctgaacaacagagccttacaatgtgccaagagatgtttggctaattcgtcaggattttccaattcaaatggtgaatgtatctcaaaatgatgaataaatcgctctaccactcgcttcaagtcaatgaaatcttggctgaatacatgaacatcgctgtcctttcgataggatagaagtaaaatggcaatcagggagatttctatttcatccaatttcaaatcaaaggtttgcaacaaggcatctttcaattcctgagcaactcggtactcgatacgctctcgaacttgttcaaattctttgagaatggctcgttcttccaagtcatccagctccatattgcgatagctaaggagcaagaaaggcaatactttgagcataaactcgatttcgtagcgattgattttcttgcccagtttcttttctaactgcgatacttgtccctgtaaaaattgtgccatttcttctgagaagagcaactgacaccccaccaactcaaataacttagcttctagaacctgcaaaaaacctttattggcatccaagaagatggtatagagaagtgagtggacatattggattttatttaaagggtgacaaacgagactatagccatgactcttagacacatagagggtcatcttgtattgttcttgagccaactgggttcgaatttcattcaaatcatttaagaccgtattacgagagacttctgtcaactccattagccgttcaatggtcactctttctggtgtgatacagatatataccaacatcagctgaatgcgctcaggcatgctcatgacgtaggtgtacgaatcaatggaatcgagaagatctcgacaggctagtttttgcgcttcggtaagtcgaataccgaggcgaggtaagctttcaatactctctacagttgttggtagggcatcattgattttttctagatggtaatagatttttcgacgtgattgttgcaagcccttggaaatagccatgattgtctcaggttcctgtagaccaatcaggtacctcagtagagcgcaactactcttatctaataacaagattctcctcctctttcccccgtcccgttactatcttaacataattatctgggatattctaataattattaaaattcatctgattattacttgttttacattacataaatatttgtagttagaattaatagatgcttttaataatttctactcgggtaatcagttctccgtgcatgttatctatccgaagggcaacatttttcaaatatacacaggcaccaatagcaatggttttctcttcttcattgagttttcgtgtcacaaaatctctcaaagtctcactaccttcacttggaatttttactcgtgcgatgatattagccacttttactttctggctggcgcgcataataatattattagaatcatcaaactgagtgaagaggtattttctaactgcaaataggatggcgaccgaaataattccaatcaggtaatcactactagaaccatgctctacaatcagttggcgagcaatggcaaccaggagtacctcaatcacggtgctaggtgactgtttgcaaagcattttgataaattcgactccgaccgccaaggtcattgcacgactcagaaaattttgaataaacgtatccgcttgaatatcaccagctaatgagctgagtaggtctgcaaaaagaagcgttgacaaggctaaaagtgctaagccaagtatggcagataaaatcaattctaaatagtaggctgtttctgtcagactatcctgtaaaaatttcctcatctttctcctcatcaaaagggaaaaagcagttctccttttgggggagtctgctacttttccctactgtttttttcacacaagaacttaatgttcatcacccttttgtccatagtaggcatttggaccatgtttacggaggtagtgcttgtccatgatatagcttggtgctggctccacccttggattaatctgctcggtgtagcggttcatccgagctacttcctcaagaacaacgctgtggtagactgcctgagcaggattcttgccccaggtaaatggtccatggttacggacaacaattcctggtacagcaactgggtcgataccacggcgttcaaattcctcgatgatgactgaacctgtttctttttcataggccgagtttacttcctcagctgtcaaagaacgggcacatggtaccggaccatagaaatagtccgcatgagttgtcccataaaatggaatgtcacgacctgcctgagcccaaccaactgcttctgtcgaatgggtatggacaacagcgtggacatttggccaagccttgtagagggcaacgtgggtcgccaagtcagacgaaggattcaagtccccttccactacatttccgtccaagtcggtcaccaccatgttttccggtgacaatttttcatagtccacaccagagggcttgatgacgatgcgaccaagttctcggcagacttctgatacgttgccccaggtaaacttgacgagcccatgagcaggcagggcgatattggcttcatagacccgttgacgcatttcctgtaaatcttttggcattagtttaaccccgctttctcaatcaatggatagaggaaatcttgtgcctccttgatagctgctcgtgtttcctcaaccgtttcgcagttttcagaccacatctcaatcaagaatggaccttggtagttggtctttttcaagactgcaaacatattgtcccagtccacacagccctgaccaaatgggacatcacggaattgacccttggagttttcggttaccgcataggtatccttgaggtgaagggctgcgatagaacggtgtcccaggtaaaattcgctgtaaatgtcattatgccaagcagacacgtttccagtatctggatagacaaagagataaggcgagtcgatttctttttcaacggctaggtatttttcaattgagttgataaatggatcatccataatttcaatgcccaacatgacctgagcctgttctgcccagtcgcaagcctgacggagattcttgatgaaacgctctctagtttcaggtgatttttcctcgtagtaaacgtcgtagccagccaactggatgacacgaacgcccaaatcctgagccagttcgatacactgtttcatggtttctaaggacttggcttcaagagcagggtcattggagccaagcgggtagcgacggtgacctgagaaacaaatggtcggaatgcggacacctgtttcatagatggccttgaccaagtctaaacgctcttccttggtccattccaaacgagccaagcgtgcatcgctctcatctaccgacatttccacaaagtcgaaacctaattctttggcaaactccaaacgttccttccatgtgaagtgtttgggcgttgccttttcatatattccgattggtcgtgccataggtcttacccccagatacgacggatttcgtctttaaattcacgcgccgctgctgctgggtcggctgcttctgtgataccgcgacctgcgataaaggtgaagacatctacaccctcgaagagtttaagggtatcaacgtccaaaccaccagttacagaaacacggaagcccatgtcaaccaattttttcactttattgaggtctttttcgccccaagtttcgccagcaaggagggcgtcacgcgattggtggtaaatcgcttgggaaatacctgcgtccaaccagagttgagcctgttcataagtccagtcaccatagagttcgatttggatttcacccttatcaccacgcacttccttgatagccttcaaagcagctgccatagttggaatagttgctgaacaaatacaagtcatccagtccgcaccacgaacagcattgtttttagccacagtaccacccgcatccgcacacttggtatctgcaacgataattttgtcttggaagaggctacgtagcacttctaccaattcgctaccaacttgaagcaaacaaacggtacctgcctcgataacatccacttcatgaccaacggaaacagctgctttaatcgctccctgcaagtctgaatggtcaagggcaacttgtaaatttggaatatgtttcatgttttttctcctaactttctaaatctaaaccttctaggtaaggactgtttttggactcttccaccattgccaagacttcctcaggagtttgacaagcaatcaaacgctcaatcgaattttccaattcgaagagggcgataatttgtggaatagctacggatgtatgaatctttggatcggtagctgcaagagtgagcagaacagacacttctttcccatctgagaagacgactggttttgtcaaggtaatcaaagcaaaggaatccttcaagacgccgacacctgcttgggcgtgaggcatagccataccaggcatgagcacatagtaaggtccatattcttcagttgatgcgatgatcgcgtcgtagtattcctcagttgcagcaccactttcaatcagcggttcaacagccttgtgaacagcctcctgccaggtttccgctgtcaatcccaagcgaatggaattattttctgtaaatgatttttgtaaattcatagtttttcccttctacacgctatatgaaagggggagggaaactccctacccctaacggctatttatagcactgcttgtaattttgttttgatttcgttgtcgtccatgaggttgtcaagaccaaccaagtgacctttcgtgcgaccttccaactcagaaatcaagtggttagaggctacgacaatatcatatcctgccgctaaaccttttgcttcaccgactgagcaagaagctgattgaaaatctgttacgccgagttgacgaagggcgttttctaccttcatcttgatgaccatagatgagcccatgccgtttccgcaggctgttaaaactttaaccataatttcactcctattttatttttaatacattatgttctgattttacagaccaaggatactattctgcttgtgcctcgccacgatagtacgcttccttatcttttgctttcgcaaattgaagttgcggaatagccaataagaagaggcagacaagaacataaccagcaataccgaggtacttaaatgcaaatccaaatggtaaccatggcacttcaaagtcaatgtttccgtggtaaccaccgctcaattcaagcaagccaacgcagactgcaccaagagcaacttgaaggacacctgagatgaaggaaaggatggctgccgctttccaaccaccacgtttgtcagcgtacactgcgatagctgcgttatcgaagaatacaggtacgaaaccagtgatgatgaggattggactcttgaagacaatcaagagaacgattgtaatcaactgaccgattaaaccgaaggcaaaacctgaaagaactgcgttagatgaaccaaagccgtaagaagctgcaacgtccaccgctgggaatgaaccaggaagcaatttgcttgagataccttggaaggcatttgtcaattctgctacgaacatgcggacaccttgcatcaaaatgaagagatatactgagaaggtgaaggctgtttgaatcacatacataaagaaggcttgtttagctgggttgtatggagcacctgaagtgataacttctggatttgccatgatttctggacccaagatgaacaaaatcacaccgaagaatacaagcatcaatgtcgctgaagcaacaactgtatcgtggaagatgttgaggaagctaggtagcttcaagttatccaagttttcttcttttttaccaagttttggtgcaatcttatcgacaaaccagattgcgaattgttgttggtgaccgatggcaaatccaccgccacctatcaatcgttgggttggctcaactgtcatgtttgagctgactgcccagtagataccacagatgataccaatcgctgctgtaccgaattggttacgaagagccgggatgaggaagagcaccatcaatgagactgttgccgcttgttgtaccatgatgtgtccagtgatgaacagagtacgtactttggtaaccttacgtagtgccaccaagaggatgttgacaccgaaaccaatcaagagcgctgtagtggctgctgatacgaaatcagggaactcctcagcaattttcccatttgctgctgcaagaccgaagtaagggtcaataactgccgcatcaatttggaacttatagttcaaagccgccaaaatcggacggaaggttgtgaccaaaccaccggctgctacgttcaaaatcatatagccgactgtcgctttgataaaccctgcaaaaacatcatgaggctttttctttaagagggcatagcccaccaacactaaaagacctacgaagaaggctggattctgcaggatattctgtgagaaccagtttaatggggtttgaaggaaatccatttttcattctccttttttgaaatgatttttatggttttattataagttatgtaagcggaaacaaaaagaccaaataaagcacaggcttgtgttcactattggactatttccgaactttaatggctgatttaatcagaattcctccctatagttcaccagcccatttattctaataatcaataaatagacgttattttacctaaaaatttaaaagaagaggttggtttgaaaccaacctcttctagagggaagtgatactctcaactcttgtatttataagaaattcacaaggttttgagtaatgctcctctggagagccaaatattattactcttctgattttttagttcttccttgcgcagcaactgtcaaaccaagtccagcaagtccgagacctagaagtgccaaatcgctttgtcggtcacccgtaatcggcagactcgccttgcttgcaccacttgtcgcttgtccagacgcttgagctgttggagtagaaagacttggtttttctaccacatccttagcctccatactacccttaacaacaatccgcgcctcaccatctacaactgtttcagataacagatttgttgctactaccttgccgtcaaccaagacatcttgataaactaagactctcttacctgccttaccttcttgaagcacataagattgaccttttgcaagtgttgcatcatagcgaacttcctctgcaatcggaaggactgtttcttctgtacgttccttggtagtaaagtctagacttggtttttcttcagcagtaggcgctgtatctggaagcgccgtagtgatataaggcaaacgaatcactgttgcagtcaaaggtgcaagaacaactgagctatcagtcaattcgacacccactaaatcagacaatgcttctacacctgcacgttcaccgtcaaccagcacttgacccttaagcaattctttgtaaatatcagaaagaacaaagctgcgctccttactgtcggcgttgacaaaaacagcatagcggtccccattgcttgcaatggtttgataggcaatgaccacatcatttttagcaataccattttgacctggaattgaaatcaagctaaccttctgttcaacttcttcttttgttcccaaacggaaggcatctgtagatttgcgcaaggcaatcaatccttttgtaaaggcctgagtacgggtattctctggatagagcgcctcatctgtcgctttggtccagtcaaacttgttgaccgcatccgatgaatcgtaagaatcatgaatgtagtatggatagtcaaatggtgtaccatcagcatttgtcaacaaatgcgctttgttcggtaccttgtcctctgtaactggttccttataatcaggatggcggaactgtttggtccgtccatactcctgaccagaatgaataaacggtgtcccttgagcagtcaaaactagcaaattacccaagcgttgacgttggtgaatttcagtatagttttcagtaactgacggatccttcttgatggactgagcgataatatcaaagagggtcaagttatcatgcgcagcaatatactggatcacatcacctggatcatctgccaagaagttgcctggttgtgccttgatgttattgaagacagactcaacactcttagcaccgcctgtgataaaggctggctgaccttcgtttggataaccagatttaagtgtattgcgaatttcatctgagaataccgcaaccgtatctgttgaactcatccagtcttggtccgctggctgaacaggctgattagcatcacctgtaaaggttctccatccttcaccaagcataatgatgtttggattgagtttttgagcctcagtaaaggccagctcaattgcttcggcatcatggtcccccatcatatcgaagcggaaaccatctaccttaaactcatccacaagatacttgatggaatcaactaagacacgacggctcatgtagtgagtggtccccagacgaccaccaccaaagcttgatttagccgtaccatctgcctccatgaagtgataatagtttggctctaagtcttcaaataagaaggtcttagaagtgtggttatagaccacatccaaaatcacacccatgccttgtttgtggatttcattgaccagatttttgaactcttcgatacgtttcattggatctgtcggatctgtagaatacatacctgtaaaggcaaagtagctctgtggatcataaccccagttgtagttactgttgcttgacgcgtactcactcatccgctctgcatttttcaattcattgacaaaatagtagctcataacaggcaataattgaatatgagtcacacccaattccttgaggtagctgagacgctctgcaaaggcagcaaaggtaccaaactgagcagtcaattcatcggaaatagcaggatcggctgtgaagtcacggacatgagcctcatagataatagcatcttcacgctgattgaagttaggaattgtggcatagttcaaatcacttggaccaacttctgctgggtccacaatcgcagcttttgcaatccgataagatggatctgtatctgccaaatcactattccactccgctaaagatttagcatatgggtctaaaacaagaacagattgatccccacgagtgatttcataatggtagtagtaaccacgatagtccgcgataccaagacctgattggctgttcaattcgaggtcccattgtcccttatcccccttggtcatggccaatttaccgaccaccttagattgatcatccttatcataaagaacgactgccacactgtctgcacttggagaccagagagtcatatcaacgacactaccagcctgacgcacacgcgcaccaagctctccatcataagcatagagctcatccttcaactgccagctcatagttgttgtgaagctatcattgccatatttgagggtatagcccgcattttcttggttgaaatccccgaggactcgcaccttgttgctggtaaggtccaagacaaggtccgtcactgcaactgtctgaccattcttatctgttacagacaatttctccaagatgctatccttatccgcaccttccaatgttgtaaaggctgcttctaaggctgttaggctaacgtgagaaacacctgtcgcacggacattattgacaaaataagggttggtgtaaatagtcgcatcatcatccttgaggaagatttgtgtctgatttttcaaatctttaaagctataatctttctgctgaatcttcacatcgtctcctgacttgctttcatccaatagcaagaagccaatggaacttggtaaatctgtcaatttgacatcaatataggcaccgtacttgccttggttttcaaaatcaataccatttggccagtcacccagggtaaggtcagtcacatcaccccagatccagagacctttttgatcataattgccatcggtacggaagtaattgatacggatgtagccttctttaagtggttgatagaggctgagttgataattctcatcaaaccaagcttcattcatcttggtgctaatccgttcaatggtcttgtcacctgtgatgttatcaccagaagtgttattaatcaacagactaatcttgctggctgtttcatctttcatcttgatatcaagataatagccatagtcatcctgtttagccgtgctgaaattggttgcacctgttggccaagcaccaagatctgacgatggtttttcgacatcatcccatgtccataaacctaggctagataaattatcagatggtagagttttaaagtgaacacggaagtagcctgcttcaattggttcttcagttgctccttgcacacttgcattgacgatgtcacctgcttctgtctgaaggagcatggtgccaccttgaccgattgttggcagttcgacttgaacaacccatttaccgtctttctcgatagcttgataagattttcctgtataggcatctgtgacaactacatctttaccagatacttcaagcgccatttccttgttctcggtattggtcgagaagacaagataggcagcttgatcttggtaactgcgtttgctgataagccaaccttggctatcatttccagcaagtgtgcttgtatcaccacgtgagagcaatgttgaattggcattgcggaaagccaataatttctgatagtggtctgtgatgtcgctagtctctaccttgctccaatcgaaatcgtaccggttgtcataaactggccagttgttttgtccagattgccccacttcttcaccgtagtaaatgactggctgacctttagcagtaatcaaaagactagcagccaatttcagtttgtccagatttccttctttttctgcgccaccgagactgtagaggaaaccatcttcgtcgtgactgcccaagaattgacccagagaagctgcactagtcagaaccttgctacgttcttccagctcttttccagctgcttttagttgaccattgaccagatatttggcgatatccttgaagccaaagtccaacaaactatccatagtgccgatacccaagtcacccttggtatccttataattcgctccccaagtttccccaatcaagtggaagtcaggatctctatccaccaattcatttttgaaatgttgccatgtggtatcatcaacgtgtttgactgtatcgacacggaaagcatagatagagttgcccttggcagttgttgaacgttccaaccaagatgcctgccaagcaaccaactgattgcgaacagcagcttcttctgtcttgaagtctggtaatccagataatgagcctaattggtcatctccctgcttgtcttcttccttagtccgtaccatacctgcaaaggtttcttctgtaccatagccagcatggttaagcaccacgtcaacaataatattgatgcctttttcggctgcggcatcaatcaattcgtggaaatcagctaaacttcccaaatgcggatttagtttctcaaaattggatgcccaataaccatgataagcatagtattctccatcttttacgctaccaacattctgtggaatattttccacaatcggagtcaaccagatagagtccacacccaattctttcaagtagtccagcttggctgtcactcctttgaagtcaccgccctggtaaagaccgcgtgggttggaggctgttccttccactagcttgtcattgccggtgtctccattatagaaacggtctgtcatcatgaagtagatgacttgctcgtcccagtctttttcaccatctgccttgatacgctctgtaatggtcacatccaattttgtttcgtagtaaccgttgtccttgtcatagacctttacaggaagactatatgtccctggcgctgtgctagacgtcgctttaatggtcacacgattgagctcagtagagattggcacaagacctccaccgatggcacttgtatcgacttccattttgactatttcagcattttcagggttggtgacggttacagataccaagccactttcattgtagttgaatggtgctttcacacttgccccaacagtcacattttttgtacctggagtagctttacttgtatcgagttctactttctcttcgataaaatatggattggtatagactttgtcgtcgtcattgcgaaggaaaatttggctatgccgtttacgatctgcaaaggctaaatcaattgttttattgcctgccaaatctggattattctgattgattagcagaaatccaagcttggaatctaaaccattcgatagaggaatgtcaacataggcgccgtatttgccaagtttaaagtcaacggcacctgctggccagccgctacttgcttcagtcgtatctccccaagtccatacgccccaaccttcataattattgtcttcacgggtgtagttgatacggaggacattttcatctttgagtggctcataactagacacgctataatcactagcaatccaagcctcattttgttccggaacaagtagctccactttctggtccgattctgttattttttccccattcttgagaaccagataaccaatcgttcctggtgtctcagattttttaatatcaacgtaatggccgtagtcatctacctgactgcttgaaaagttcgctgtatccgttggccattgattaccatcggacggctctgccactcctccccaagtccaaagtccttgactttctggtgctgtttcatctacattttcaaagtgcagacgaatgctgccttcttcgataggagcttcctctggagcagttgcatcggctgtttctgttaccgctgtcgcttcagctaccatagaatctgtagcttctatcgcagttgtggtcgcttctaccgcgccgccatcctgttccgaaagagtcgttgaactagttgacgcagggaggacaacttcctctgcctgcactagttgacctgctccacttaaaaacagagcagccgcaatcccaacagaggctacacctacatttagtttacgaatgccaaaaatctgtttcttctctagcatccctgttcgtttcatattctgaacggatttctttttcatagactcctccatataaataagtttgaattgtacactaccagtatatacaattccaaggagtctttgcaaacgttttcttaaatgttaacggtaacaagttttgagctactatctaacaaaaatagaataaatagctcccccttcttttgctcctagaccgcccactgaccaaaaaaagagactactgaggtgtagtctccctttcaattaaggttgcctggcagtaatgcccctgtctagccagaggcttgccatccaatatcgtcattaaatgtttgacgctaagagcccccatttgacgaatcggctgcttcatcgtcgtcaaggctggtctggacatcctatctaaaaagaagccgtcaaaaccaatcaccccaacgtcattcggaatagactttcctagagcttgtaaacctcttgtaaccccaagagcgagacgatccgatgcgcagataaagcaggtgttttctggtaaataatcaagatttttcacaaattcttccgcaacacgagaacgattttccaatcgatagagatgagtttctcggccctgcatcgcatctttgtagccttcttctctccctttttcaaaggcttctggcaagtcaatccctacaaaaacaatcctctcataaccttttgataaagcaaactgggttgcggacctagtcgccaaacgattgtctgaatctacaaaaggaaggccttcttgattctccccaaataaaatcaatggcttccgcagccctttcaaccaagggtagtcatccttgcgagcgccagtcacaatgtaaccatcacattgatcagtgatctgacttggattggtcaccaactgcaaggtataatttcgatgattgagctcatcagcgattcctgcaagaaggtcgatatagtacggctctaccacatccatcttttcgagaatgacagcctgaacaatcagtgtccgttgctgggccaaggccttggccgccacatttggcttatagtttaattcttccatcgcagctgttacgagcgtccgcagctcttgtgtaacttgttctggatggttgatgacacgcgaaacagtcatctttgatacattggctaacctagccacatcggctaatgtcgtcatagaactcctccctaattctatttctgttgcttatcttttagcaagcaaacagtcaaaattgtgcaaacgttttctttaggttattatatactatttattactaaaaagtaaagacctttcgaatacatttatcgttatttagttttccttctattacttccttagctcaccttgcctaacttcatctatgcctgcggctcatcgcctcgtgctaaaagtactatataagaatacccattccctctaaacaaaaaatactccaactgctagaccaatcaatgtctaacaattgaagtatctttgtcaaattctgtccattttctgtacgattatggaaatgaataagataaattaatttgcttagcttactcaacatctaccttttgaatgcgagctaagaattgcttagtacgttcttcttttggctggtcaaaaatgtcttctggtcgaccttcttcgataatccgaccaccatccataaatatgactcgatcagctaccgcacgcgcaaagcccatttcatgagtcacaaccaccatggtcataccttcttttgccaactgcatcatgacagccaggacttcaccgattaactcaggatccaaggccgaggttggttcatcaaaatagatgacctcgggattggtcgcaatggctctggcaatgccgacccgttgctgctgaccaccggacagctgacttggatagaaaccatatttatcagatagtcccaccttgtccaaggctgctttaccgattctttcagcctcttgtttgggtactttccgagccacaatcaggccttccgtcacattttgtaaggcagtcttgttggcaaagagattatagttttgaaaaacgaaggctgtgcgcttgcgaatgcctgcaatttccttcttggtcatctgagccaggtcatagctgtcctcaccgaagactaagtgacccgcgtcagctttttccaaaaagtttaaagaacgaagaagagtcgtttttcccgatccagacgggcctaaaatgacgaccacctcacctggattgacctctacatcaatcccttttaacacctgctgaccaccgaaggtcagctttactccatttgcttgaatcatctgaacctcctaatagactgccaacttcttctcaccataggcttgaagcttggtcaaaatagttgaaaagaatagataaacaagggccacctcacaatagagggcaaacggttcgtaggtccttgctgcaatctgctgagttgccataaacatctccaaaacggtaatattggcagccagcgatgtatccttgaccaatccaatcaaagtattggacaagggcgggaaggccactcgaaaggcctgtgggagaataatcctacgcatggtctgagcaaaactcatcccgacagaatagccagcctccaactgccccttaggcacggactcgatagaagcccgtatggtttccgcagcgtaggcacctgtattgacagaaaaaaccaaaaccgccgacggaaaagcatccaagacaattcctagacttggtagcccaaagaatatcacatagagttgaaccaagagtggtgtccctcgaacaacccaaatatagaaacgagccacttgtttgagaatgggaatctgagcaatttgcaccaaggccgtcccaatagcaattaacaagccaaaggtaaaagacaggattgtcagtgggatagtcaccaacaatcctggaacaagtatttgtgaaaatgaatcaagcaatagttgccatactctctctgtcattgtttctcctgattacttagcttttgatacgtcttcaccaaagtatttgtttgaaatttcagctaattttccttcactagccaattctgccaaggctgcatcaatctctttcacaagatcttcatttccttttgcaactgggaaggctgttgtcgatacgtcatccgtcaaggtcacaaccttaatcggtgcatcagcatgttgtttcacataatccaagtacaccaagttgtcattgatggtagcatccacacgtcctgtatttaacaattcaactgcctgagagaatccatccacaccgacaacttctgcaccattttcacgagccaaatctgcccagttacttgtcaagctgttggcagattttttaccagataaatctgcaaagcttgtaatgtcagtattatctttttgcgtcaccaaggctccatagatgtatgtatatggtgttgaaaaatcgtattttgccttacgctcatctgtaataccgacttggttagcgatggtatcaaaacgggccgcatccaaacctgcaatcatggaatcccattctgtttcaacaaattccaccttaacacccaatttctcagcaacggcttcggctacttctacatcataaccgaccaatttcccgctctcatcgtggtaagagtaaggagcataggcaccttcagtaccgatttgaataacgccttcttccttaatttgtgccaagagggtttggtctgtactattcgatgtacctgcagatgaattgcaggctgctaacacgatacccgcaaacaataaacttgtaaacatagctattttcttcataattaaaacacactttctttttcagattttacaatagtatcatgaataacaatttccagccaatatattttttctatcggggacattaaaaattttaatcaagtatcggagcataaaaaaagacctactcggtctttatatctcatattaatttactccagctggtgggtaaatatagctgactgttccttcgctagtcgttgttggatcaaagaaacctcggacattacttgggtagtatactccaccatagtttgattccttaacttgaatgtgaccattagctgccacatctgttacataggcaacatgaccgtagcctccatctgtccatacagcaatagcgccaacttttggagtagttcccacttcatatccaagcgctgccgcactagctgcccaatctccaccattaccccaatagtttccaacccaaggagccatttctttggcaccccaagtacactgacccgctggataggtattagccgtatattccaaagcaacctctgacaccatattggtagccaaagcagcctttgcagcggcagcagctttctcagccacaattttttctgcagcagctttggctgctatttttgcagcttcaaccttttttgttaacgctgatactgtcggactatcgcttataactgtgtcatctgcactgacattcaccattcccaaccataaaagatttcctatgagggctgtaaacagtcccaatttgaattgtttttttatcatttgataactcataatatttgattccttcgtgtttttctgccctatctatcctaaaggataatccttgcagagagcttaaaggaatgtaacaaatattacagataacttgcaatctcttaacaatcacagtgtccggactttttgtcaaaaaaacgacctccaatacggaagtcgttttctatttagtgttagtgtaattattttctcctactcctgagtacactgattagaataaaaaccaaaccagatataatgtttagatatttattcccataaagcggactaatcgcgataaggaaaaatcctagcgccaataagaaaggagatttgttcttggaaaacattattcctcaccagccttaaccttattggctgcaataacaaatggtgtccaaatcaggaaggcaacaaagaggttgaatagtgaaaccaacgcagccataatgttaccacctgttgctagataagcgtagagtcctggaggggtaatccatggaacaggagcaaagactggcggaattatacctgccgctgtcgctaagtatgcgatagttgcacaaatcggtggaacaattagccatggaatagcaaacagtggattcaataccattggtataccaaaggtaactggttcgttaatattgaatacacccattggagcagataatttagctaccattttgtattcttctcgttttgagaaaatgaaaatagcaataatcaaagctagagtgacgcctgaaccacccatttgagcataagcatcaaaggaaccacgagtccaaagccacggtaaattcgcagtactatgagttgcagtataagcagccgcattttcatttagtgcaaccatatagactccgtccataattggcgccaagacattgtgaccatgcaggccgaagaaccaaaaaagttgtacaaggaaagttaaaagaatgactgacccaagaccttgtgacagaccaagtaatggcagttgaatataagttgatactaaatctcccaaagattgtcctgttagagtaaatgcaagatatgccacaatggatgacgcataaattgcagcagtacctgggataatagcagcaaaggccttattaactgccggtggaacagaatctggcaatttaataatgacattccgttttacaagacttgcatagacccatgtagcgagaaatccaataaacaatgctgtaaacaaacctgttgcaccgccatatttcaatgcgatagctccccactggcttgtttccaaggctgaaactccatctgtcgtcacaatggataatcccaaaccttccaaagcagaaacaactgacttatcaactccgtctaaagcagtggaaatcgttacactttgaggaatagtagagatgaatgatgcaaaggaaattaaaccacctgctaaaggattcaccttatacatgagtgacaaattgtaaccaaaggtaaaggcaaatacaagtgccattatcccgatagttccaaaataaacgtaaccattgatatctatcactggttgcatggcatcagcaaaaccagtccatcccatattatttgggatgtctctcagaaagacattcaatagaacggccactgtacctgccatcgtaatgggcatcatagaaataaaggaatcacgaatcgcaatcaaatgccgttgcgaaccaatttttccagatatttccatgaacttctcagaaatatttgacatattctgtctccttttctattttttgttttatatttcctaaatgttaaactgataccggctcaactgagcaacgaatcagcgcctctaactgggcatttgtctgacgttttatactttttgaaaagattttttccatgagaaattgattgccttttacaaaaatatcaccagcctccatctcataagaatattctatattggtttgatcattccctaaatcctctaactgatagcgaacatgctcttttcctcgattagaatggaaacaaactgcatagcaataaggagctgtaaactcttctacagttaccttgacactatgttgtcccttatcaccaaatgttttagtataagtaagtccctggataatgtcttgatcttgcaagatggaacccgtattttgctgaaaatcatcttttaaggattggcgaatagtagcgaaaagtcgctcaattggaacttgacctatttttgatatcttcataacccagttctcctataattatccaatctgtttataaagatctacgaactctttcgctaaatcaataaatgtcaaagcattcatcaagtgatcttgtccatgtaccattaacaaagataattcaacagactctccacttgcttcttttgctaataattgtgtttgcgatttatgggcaatattcaatgaagctattgcgtcttggagcagctgttccgcttcgtcaatacgaccttctttggctgcttgaatcgcctggctagcgaagccctttgcttcaccaccgtacatgattaaccccataatcgcttcaagatactctggagaattcatactacccctccatcatttttagggcagcctctagcaccttagctccgttcatcactccgtaatccatcatattgatagcatctaccttaatagttggctcaaattttgccttatagtcgttcaataggaattttacttgtggacctaagagtaatacatcaatctctttttgagcaacttcattatcggcttcagatactggaacagcccaaatagttgcttcaacccctgtttcttctgctgctttttgcatcttagttacaagcatacttgtagacatgcctgcgttacaaactaacataatgtgtttcataaaaaactcctcctacccctttctttgaatgaggggaataaaaatatcaattaattctttataatttggatgatgtaacaaacgttcttggagaactctatcttgaacaaaatcaaccagacaaggtgagatatacttcagaaatgcatttcgaccctttgacggtgacaataggaagacgaattgaacttgctttccatggccccaatccacagcattcttatatatccctacaacaatttgttctgaataactcatcggcaaggctggatgaggaaaggctaaccgattcccaaagacaaccggactgtaagattctcgtaaattcacttgttctataaagcgattaacaaaatcaggctcaatggattcgtccaaagaggttactagttgcttcaaggctacttctcgatcacaatcctcctcaagatagattattctatgtggagcaaatactgcttctgcaatctgcttagcctgacctacttccattagcacattttccccttggtcaggaataactggggtcgtttgctgtaaatgagatcgaatagcctcaatgtccttctctgataggaagacgctgacattgataaccggtgtcataaaaattagattcgacaagctaatggatgaaataatcaaatcaacatccttcagtcgttcctctgtaacttcataataactaaccgtatcaagaatttctaagctggatgaaaattctttctccaagcgattctttaacatcaatgcacttccaattccggtagcacagactaccaatactctggtcttcttaaatccctgatagcgttcaattgccgccatcacatgtaaggtaaggtaagcccactcatcatccgaaatcgaataccccattagttctggtatcgctgcaaatgccatttttgttaattcgaaagcctcaaaatattggtctttaatttcagcagttagaggatttcccagttgaatattattctccaaacgaatacgtaacggcatcaaatgggccagaactcctttgaatagctgctgatcctttgacaactctaggcctgttaaatgtgacaaatgtaaaagactattctccacattctgtctaaatatctcttccacctcaccatcttgatttggattccccgttagttttaccttaaggtgcaacgcaatgtaatttgcttcctctgacggtatcgtcacttgaaacgtttcttcgattcggtctataatccgttgtgccacaagatactcttgagacgactgaatacgctccggtatcgggaatcggtctagaccagacccgattttcaaccgttgtaaaagaagagcgatatggagcactagattctgcatgacaaaatccgataaacgtaatttagcatcccgacactcgtctaagacgattaacattaagtctgtgaaccgtatatctggcaatagattggtttcgacaaccccataaacagattgaacatttccctcatcaaaaaagtaatccataataaagtgacggatagcaggttcatccccctttagttcaattcctttacgtgtcacaaggagttctaattgataggggataaatagttttcgaatatccgccaaaatggaatgaagcgtagtctttccaatgaatagctctctttgtaaacaatctggtgactgaatcggatcctcaaacaagagcttattgagaatataccgttgccgatcccccgcttcttctagttgagttaaatcagttaaccgcttttttaggagcaattgctcctgccaaaacatttcaaactcaactggccgttcaatctgtaaacaataaccactaccttgttttgaaaggatatgagcaccgctattttctaaagaagatgtcagttgatgaatatacgttcttaccgttcgatcactcactgataataccttggctagttcgatgcttggtacgaatgtctcctgttttgcaagtaaagcctctaacaagcgtacttcttttttagataacatgctccctcctttcctccaacagtctttgatttcttatatgtacattataacatgaaagcgatttctggaggtgcctactttttccgcatcattaatgaaagtgctcggaagctatgaccagtttaaactcttgccacggtttaataaagcgtaacaagggaagatagtctgggctgattcgtccgaccttatttacctttggactgatggtaaattctttgagtgcaatttgcaattcacccttgtagcgaccatataaatcattatcaattaagatatcacctcgtcccacaggaattgcttggtctgaccgagccggtacagatgcgtccttatacaccacacggggcatggttgaacgcagaacataagcagaaatatcacctctataaacatgattaaacgctacaatctctctttcaacgggagtcaaaccctcctcaatatcaaccatgaggctgattgtatcttcatttaaaactgtttgaatggattgtagttcctcctccgagataaattggtttgaaatcaaaatagaatcaataaaacccgttgccttcatccaagcaatttgcaagggaagaggccagaaccgatgatcttctaaagttggtaggccttcagataatggccacggtccttcagaagctgtttgtgcactgacaaatgccgcagttcttatacctgattgatgataaaaagatgacatctctaagaagtgctcttcggataaacctgtaaaagcatgaggataaaaattatggcaggcaataatattatccctgtttgcaacactagccaaaagattggacagcaagatcttatctgtactcaaattcaattcaacttttatgttgcgtggattatgtgtcatctcaatgatttcttccaaaggaagagcttcatcaagacgaatcccggccaaccccagttctgctgcacgctccatcaacgccccatcccaaccttgcgctgcgataaaatggggactgatatctgcaatgacagtcatccccagttgatttgcatagtcaattagtttttgatacaattcgaaaactgttcggtctccattttcaagttgcaacaaactcataaataagcgccttgctccgtattggtgcagaagtttaatgtaagcttgactctcttctagcgaatagttttcaggataaattgaaaagcccagttctaccatcattccctcctagcgatgaaaaccattagcatcgctcaatttcttgaaccacttgcctgatttcttaacaattctttcttgcgtgtctagatccagttcaactaatccatagcgattcttgtatgcatttaaccaagaccagcaatcaataaaggtccataacatgtatcctttacaattcgccccttcttggatagctcgatgtaattcaattaagtgatcttcgataaattcgatccggtaatcatcttgaatgagtccattgtctttaaatgcgcgctctccttcaactcccataccattttctgttacaaaccattcgatattatggtaattttccttaatatttatcgcaatatcgtatatccctttttcataaatctcccaacctctatgcggattcatttttttacctggcatatcatatggggcaaagaaatattccggagttagaggctctccctctttccaactattggttggagcttgtacccgaaggggttgataataattcacccctaggaagtccacacgattttccttaataatggctaattcctcatcgctgacctctggcattagaccatatgcatcaatcagctcgactaagtcatcgggatattctcctaacacagacggatctagaaagctctttgtttgaaacaattctgcaattcgagctgcttttatatcctctgcttgctcactacgagggtaggcaggagttagattcaagacaatagcgatttttttgtgaggatttacctcatggcatgcctttacagctaaagaacttgccaactgtgtatgataagccaccgcaactgccgcttttgcatcaaccttacatggataatgataatttcctagataaccacactctactggaacaatcggctcattaaaggtaatccaacgatcgactaaatcatcaaacaattcaaaacatgtacgtgcatatgcttcataggctcgaacaatttccttattttcccaaccacctttttcttgtaaacaatagggaagatcaaagtgataaagattgacaaagagctgaattccctttgctcttaccaaagaaaaaaccgaacgatagaaggacaccgcctcttgattaatttctccagtacctgttggtatgagacgcgaccattgaatggaagtccgaaatacagtgtgtccagtttcaactagtaaatcaatatctttttcataatgtttgtaaaatgttgatgtttgactagggccaattttgttatgaaatcgttcaggctcaatactataccaataatcccagttgttctgtccttttccatcacctggctcgattccttcactttgaggtcctgatgtagaagaaccccacaaaaaatttgttggaaattgataaaataccttgtctttagtcattgattgttccttctctcttttatgtgctgtatagctggtgcgaattgtggcaaatagttctcatgtgcaagtaacatatcttgtaatagcacttcagcttgtggtccatttgaaataagcgggttgagtgtaaaagcttgtaaagccagggaataatcacctgtcattgctgcctgaacagtgacaagctccatttgcttcatcagttgtaaatagccggttacaatcggcggagttggtggacaagctagtggagttgctccttgcgcagagataatcgaggtgacttctaccacacaattttcaggtagatagggaataactcctctatttacagtagatacggtcaattcttctctactatcattatggatagcacaaataatttgacaggcaacatcactatagtaggcacccccacgtagttccagttgttttggtttgtctttcaattgtgggtctttgtaaagctcaaacaattctgtctctacttcttgaacaaccttggctcgtacattaccctgacgatactgttccaaagcatcctctaacatttcttgttccaaaaaataataacgatggtaatcacatggcaacattccaatcgtccgaagcaattgaataggaaactctagattagtaatatttttgactgcttctggcatctcctctctcaaatccccatacaatgtttctaagattacttgcgtacgattttccccatacttatcccaaacttcatgaaagtgaaaatgatttaacccaatatggcgcgtacttaggtctccttctgattggcctaaaatctgagcagcaagtttcttttgaccaatagggatattacacaaaccaataactttcttccagtggagttcattagcaatggcttccgttacgataccagcaggattcgtaaaattaatcaaccaagcattcggacacaagtccttcatatccttgataatccctttatatgcttcaatggtcctaaatgctttaaagattcctccagccccattggtctcttgccccagcatcccataactcaagggaatggtctcatctaagtatcttgcaggtagttggccaactcggaactgagacgttacaaaatcagcctctatcaatgcttctcttctgtctaaggtcgactctatcttccagtccaggcctgcttttgcgaccattcgccgtgctaactcaactacgatctcctgtttttttgcgccttgttcaacatcaacaaaccaccattctcgaatgggtaattgatgtgcacgaagaatcataccttcaaccaattctggagtgtaacttgagcctccaccaattgtcactaatttaagagttttcaacacgctttccctccctcatcttcttttatattcttattatatttcagtgaacatctattgtaaacggatacacagaccctctttttccgtatcacaacggaaattaagacaacatgatcattctagaaaatacaaaaacgacctccaatacggaagtcgttttcttattatttacatttatttcacaacaatattaactagtttattcggaacactaatcaccttcaccactgtttgaccagctatttcagcttggactttttcatctgcaagggcaactttttcaagttcagctggtgctaagtctttggctacggtcaagcgagcttttaccttgcctttgatttggacaacgatttccacttcgctttctaccagcttgctttcgtcatatgttggccatgcgacatagctgattgactggcctgtatttgcaagaccctgccagagttcttctgccaagtgtggtgcaaatggggcgatcaattggacaaaacctttggcgtagtcaacataaagcttgtcttccttgttggctgcgttgacaaaaatcatgagctgggcgatagctgtgttgaatttcaggtcttcaatatgctctgtcaccgtcttcacagtttcattgtaaactttatcaagcgctccgctattttccgccacaagctccttagtggttaagaggcgatagacacggtcaaggaacttacggctgccttcgagaccttcttctgaccaagcgattgacgcatcaagtggacccatgaacatttcataaacacggagagtgtccgcaccgaattgctcgaccacatcatctgggttaaccacgtttttaagagacttagacatcttagcaggtgcctgctccaactcttcaccagtttccatgtggaagaaggacccatcgcgtttttcaactttatctgtcgctacaagggcaccacggctgtcgcggtagctagttcccaaaatcatcccttggttaaagagtttttggaatggctctttggtcggcacaacgccaaggtcgtaaaggaacttgtgccagaagcgagcgtagagcaggtgaaggactgcgtgctcagcaccaccgatgtagatgtccactggcaaccaagctttgagaagatcctcgtctgccaatttctcatcattgtgcgggtcgatatagcggaggtagtaccagctagaacccgcccattgtggcatagtgttggtttcacggcgacctttaacaccgtcttcacgcaccacttccaaccagtctgtcaagttagcaagaggtgactcccctgtacctgaaggcttgatgtctgaggtttttggcaataccaaaggtaactcattttctggtacggctgtggaagttccatcttcccagtggatgattggaattggctcaccccaataacgctggcggctgaagagccagtcgcggaggcggtaagaaatcttctcctgaccgacaccgttttcttccaaccaagctaccattttggcaatagcttcttccttgttaagaccatctaggaaatcagaattgatgtgggcaccgtcctctgtgtaaggagcttcttctacattgccaccttccagaactggaataatgtccaaaccaaactgtttggcaaattcccagtcacgctcgtcatgagcaggaacggccatgatagcacctgttccgtagcttgccagtacatagtcggcaatccagattggaatttctttaccgttgacagggttgatggcataagcacctgtccagacaccggtcttgtctttagccaggtcagtacgagccaggtctgatttgagagaggcttggcgtttgtattctgccacagcttctgcttgttcagctgatgtgatactatctaccaagtcatgctcaggggcaaggactgcgtaggtcgcaccgaaaagggtgtcaggacgggtagtaaagactgtgaagtccttatctgtgtccttaatcttgaaagtcacattggcacccgtagacttgccaatccagttgcgttgcatatccttgatagactctggccaatcaacttcttctaagtcattaagcaaacgctctgcataggccgttattttcaacatccattggcgcattggcttgcggacaactggataaccaccacgttcagacgttccgtcaggaaggacctcttcgttggcgatagctgttcccaattcttctacccagtttacaggcacttctgcctcataggctaggcctttttcatacaatttggtgaaaatccactgagtccacttgtagtagttagggtcagtcgtattaacctcgcggtcccagtcgtaagaaaagccaagggcgttaatctgacgtttgaagttggcaatattttccgccgtaaagtcagctgggtcattgcctgtatccatagcgtattgctcagctggcagaccaaaggcatcccaacccattgggtgaagaacgttgtaaccttgggcacgcttgtaacggctgagaatgtccgtcgccgtatagccctcagggtgaccaacgtgcaagcccgcaccagacggataagggaacatatctagggcataaaagtttggcttttctgcatctgttcctgtcttaaaagtatgattttttgcccaaaattcttgccatttgggctcgatttccttgtgattatagaagctcatgtcatttctccatgtcaataaattatctttactattatatcacgttttgggggaattgggaaagacaaaaacagccagttttcactagctgttttcccatttttaccaaataatcacacggtcttctttggcacgccacatgccgtcgccttcttgaacgccaaatgtttcatggaattcatcgaagtttggcaactggatgttggtgcgtaggtgacctggtgcatggacatcgacactagccaacatctgcatgaactcaggacgagccttcattcgccagatgcgagcaaagttagtgaagaattcctctgcggagaagtcatcttctgacttggctgcttctagggctgccgcaatcccaccaaggtcggcaatgttttctgacacggtcaatttaccattgattttggcaccgtaagaatcctgaccctcaaactggtcgatgacctgctgagtacgagcttcaaaggcagcatagtcttcctctgtccaccagttattaaggctaccatgctcatcaaaggaagcaccgtttgagtcaaaggcatgagaaatctcgtgggcaataaccgcaccgataccgccgtagttagctgatgaagactgctccagagagtagaaaggcgcctgcaaaatggccgctgggaagacaatcaagttcttctgtggattgtagtaggcgttgaccatgtgagctggcatgccccattccttaatgtccacaggcttgttccacttgctccaaccatgagcaatgtcaatcttgtttagttcgatggcattttccaccaaggacttgcttgggtcaacaagcttcttataataacgctctggcaaggcttctgggtaaccgatataaggcttgataacattgagtttgacaatggccttgtcacgcgtttcctgagccaaccagtctgccgtttccaaacgagatttgtaaacctcaatcatcttggcaactttggcttccacatcggccttggcttctggtgagaatttttctcctgcataccaaagaccgagggcttggttaaagtagccttgtgccaagttgtaggctgctttttcttggttttgcgcctgcggtgtaccagaaagagcacggctgtaggctcctgctagaatacggatttcatccgacaggaaggctgtataagctcctgccgctttcaagatcaaggtcgccttcaaaagctcccaattatccgcacagtaaatgtcctttgcagcctgccagaaacgttcctcaggcacgataatcttgtctggcgtttgacctaaaatcgctgtgaagaaatcatccaaaggcaactctggtgccaaggcagtaaaatctgcccactcgtaggggtgatagagttttgcatactcagaaccctcttcatttgacagaacatacttggcaatcgtggcatctagttccaaacgcttgtccaagaggtccttgatttcctcatcactgaaaccaaacttaggtaagagggcttcttggctctctctccacgttttgagcaactctgctcctttttcatgcccttcttcatagtaggtcgtatctggcaggataatgcctagagaatctgcccagaggacattggtggtcgcgtccataaagtcaggtgccacaccgaaaggcatgaggtttggcttgcctgccaactcatattctgccagcttgctggtaaattcttcgaaagagttgagagccttgtactctgcaatcaaggcctgggcaggttctgcacccaaacggtcacggatttcatagtcagctacttgtttgtgaaaagccacaaagttttgcaaaacgctatcttctgggacatcttctcccgccaaccaagcgtttgtcgtgtcaatcatgagcttttcaatctcatccgccaagtccgtgaaaccacctgttcttggcttatcatctggaatcacggctgtttttgcccattcaccattgacgtattcgtaaaaatcatcttgtaaacgtatcattgattttctcctttgtctttcttaatgactataataacaaaaaattctgacaatttcacttatcagatgaccgtgaccaagtattttttagaataatactcgaacaaaccacaagaaggctgacaacggcacaggtccctgacatggttaaatccagttgattggccactaaaaaacctagcacaaccgttagaatagcgataccttgccctaaaagaagcaattgccaaaaggatttgacccaacatagggcagccatacttggtgccaccaagaaaacaataacagtcatcgaaccaatcgcttcaaaggccagaacagtagttaaggaaactagaatcaaaataaccatttctaaaatccttgttcgtaagccagacaaacgagcatggttgctgtcaaataggtacacttgtaaacgatggtaagcccacgcaaaaaatagaacaataaccaaccaagccaaactcgacttgaccagactaacagggagtgaccaggctagaacatccatacgatggagcggagcaaaaagtacttccccctgcaaaaccagatccacatccaagtgaacattgcgagcaaaaagagaaataagtaaaaccgccaccgcaaaaaagaaagaaaaaactagacctgttgcggcatcatgcgctatctttcgactatgcagacggtcaatggcaagaaccgataataacccaaacagactggcaccaactattagcaatggcgaatccaaactatgactaataaaaaatcccagaacaatcccaagcaaaacagaatgcgatagcgcatctgccagcattgattgattttttacaaccagtatcgagccgagcaagccacaagaactagcaataaccatcaaaatgagtaatacttcaaacacgaccattctcctttctgacataggtaatatacacaaatgcagacagggtcagacctgtcagacagacgataatagtcggtccggtcgacaaaccagatacactggagctaatccaggtccctacgaaagccgacccaattgcaacgattcctgccagtaatagactcttgtgatacgattttcccagcatcaagccaaagacagctggtgcaatcaaaaaactactcatcaaaatagctccgactaactttaatcctactgcaattaggcaaatcatcaaaaacatcgtcaactgctgcaagtactttacacgaacaccaataacccttgcaaaagtttgatcaaacagatatagcttatagtcttgataaaagaaagcaaacaatgccaaagccaatagagaaataattccgatgagtatcacatcatccagctgaataaaggctgcctgtccaaatagataggtttgcaatccagcctgggaagcccctgcaaaggcttcatttccctgaatagcatttttcaagaccattcccaaaccaaagaaagaagcagacaccaatgaaagggcattgactaggctgtgacctccttttcgacgcagccaatggacaagtgcataagaaaggtaacctgacaacactgctcctaacagcaagtagagaggatgtcgcgactgaaaaatcatgaaagagacaatcactccaggataagaagcatgcccaagagcatccccaagcaaactctgtttagtaagaacagatatacttccgatagtgctggctgctacagctaggctgacggtccctaaagcaactgtccagaaagaatactctttgaaaacctcaaacatgactgcctcctttggcatttcctagaaacaacccatttcctatgccgtaggtcgcctgataattctcgcttgtcaaagtctcatccatcggaccagagtcaatcacatgcttatgaagccagacaaggtgatcaaagtaggcatccagcgtcgttaagtcatgatgaatgacaatggaagttttcccttcacattggaactccttgagcatatccatgatcatgatttctgttgcctgatcaatccctgctagaggctcatccataagatacaattctgcttcctgtgccagggctctcgctaaaaatacccgctgacgctgcccacctgaaagctgatcaatctgacgatggcgtaaatccgcaatttttaaccgttctagagcctgctcaacaatctgtctatcagccttagtcggtcttctaaacattcccttactatgagcgaagcgtcccatcagaacaatttcaaagactgttgcaggaaattgccaatttacttgactggattggggaatataggctactttttgagcaatcaacctctctagacctgcctcctgaccaagcaagcgaacctgccctgtgtcaggtttttccaaccccaaaatgaccttgaatagactggacttcccagcaccatttggtccaacaatagccgtccgactccctctgggaatcaccaaattgacatcttctaaagccatggtctggctggctgtatatgctaaattgacatcttttaattcaatgattgctgacatatttcctcctatttttaaaaatgatatgcctcattcatactcaatgaaaatcaaaaccagaccaacctaccaagctgagaaagtcgataagattaagataccgtaccaacaaattgctggcaaaccctatacatcgcttatttcaacacatcagtacatgaatttgattttcgcagagcaccaatgcttccttcaatcgtatgtttataaatctgttaaaaatggtccaaaaacggaaagaactcgacctagaccgcgtcctttttactactcatttgaaatctctattcacgcacagactactgatatataaagtcccgctgtaaaccaagatcatcgaggtctacaagcggtatttctagtcaaggacctcaataactggtgtgatttgctactaacgcctatcctcccccaagcgttaccacctccaatagaaagagccctataccgcttgtgctcgaaacaattgattgtccctcatattggtacctatcaactctatctttggtaatatctctagtcttcattgaatagcaagtccgttcgacctgtactatttcagatatttaaccatcagtttaacattatgtttgtacatgtcgataaaggtatccccttcctcgccttctggtgccaaggaatctgagaacaactctttaccttcgccagtaacaacttcaacctgaccacctttggcttttactgcctcttgcaatttcttcatgcgttctggattggttgtagactctgtaaagatagccttgatattatggtcgatgattaggttaactgtctcaatcatgtcactgttagccacttctgagtcggtgctcacgccttgaggagcataaagagtgaagtcataactagcagcaaagtaattaaaggcatcatgtggtgttaccaaatagcgactttcttttggaatcacacttaattctttttctacccaggcatgcaaatcatctagctgcgcttggtatttttctgtatttttctgaatcatctcagctttagcaggtaagagtttttgtagttcctctgaagctacagctacagctgacttgtacaagggaattgaaaaccagaagtgcggatcgacaatctcttctccatcctcatccatcgtattcaagtcttttgcattaaagtttttagaaacagctactccggtcttctccaaagcttcaaccattttaccttcaaagtgcaaaccgtgatagagaacaaggtcagccttttgtaattttgataaatcactagatttggctacatacaaatgagggtcttctcctgctggaatcagcaaatcacgttccacctcatcacccgccaactgatagaccatgtcattgaggaaggaagtagtcacagccactcttggcttactagagccttctgtggtttgcgatggacgacaagctcctaaccctattagggacaatagcagagcaaaactgaacaatattttcttcatataggttctccttttatttttattaagcatacctaactatataattagattaatctaaaaaaatcattttgtcaactgatttttaaattttttgatataatagtttcagaagaaagcgagttctcatgacaccaaacaaagaagattacctaaaatgtatttatgaactgggtcaattagaccaaaaaattaccaataaactcatcgcagagaagatggccttctccgcaccagccgtttccgaaatgctcaaaaaaatggtagccgaagagctcatttctaaggatgccaaggcaggttatctcctcagtcaaactgcccttgaaatggtagccagcctctatcgcaaacaccgcttgattgaggtattcttagttgagcaacttggctactctccagaagaagtacatgaagaggctgagattttagaacacaccgtttcagatcactttatcaatcgcctagacctgctactggaacagcctcaaacttgtcctcacgggggaagcattcctcaagcaggacaaccgctcatcgaacgctaccagacacggctgtcacagctaactgagacagggaactaccagcttgtccgtatccatgacttctatcaactccttcagtacttggaacaacatgaattagctgtcggtgatttactaaccgtcacagccttcgaccagtttgcccagaccatcaccatccagtacaaggacaaagagctcgccgtcccaacagccatcgctcaacaattattcatcgaaaaaagcaatcgcccagcctaaacaagctgagcgattttttcttctaaaataaatagttacctctttttcaaattacggaaaatagatctggctgcaaaaaatagttgcccacatacatacaccaaccaaagtaggaaacctatataaaaacagcccaatagaaaatgagggttataggttaaaggctgcaagacaaacatgagaatccctaccaacccccaccgcataccccaggtcatctttctctggataatccactccagccaatcttctccaactgaacttctggtttccagatactcttgattaaggtcttgaaaaaattttctcatatttctgcccacctctgcacttgatagttagcaattataaaattgccaacttcctctcagtatacaggcatttccacaaaatgtctactgtcaatttttatccaccaatctgcaccaaaccaaataaaatttggaggaataaaatggaggcattatagaagctatgtgcaaggatagtatccgtcattcgtctattgcacatatacagatagcccagataagcccctgtgataaagtgacctaaaaatgccactgaaaagttccaggtatgacaataagcaaatagaagggcagaaaatacgatgaccatttgaggatgcttaggaaaatactgggctgtcttttctaacaaaattcctctgtaaagaaattcttctaaaactggagcaaacaagacaactgagagagccatcaccccaaaattgtccgaatttaactgattgactgtatccatggcgttagaatcactaaggctaagacccaaatactgccaaaagaggttcaggcaagtttgtccagtaaataccagtgctgtcattccgactatttttaaaacattcagcttctctcttgaaaagacttgatgcttcatcattcctcgtctgatgacagaaagtagtgccaatattggaagaccaagccctatcatgactgcaagttttagtagcacattctcttgaaaggctgttatccccacataagctggaaattgaatgagcaaagtgagcagcaaggtacccactgctaaaacgatggattttattattttcatattctctctcctttccattgtcatttataacctactcaattgtttttcacaatgttcacacctttaaacacttataacatttaaaatggtcacaatactgttcgacaagatatgtgccactatcggatatttgagatggttcgttttatagtaaatccaagaaaacaaaaatcctggaaaaagtgccgaccagaaactcaaagaaatttcataactatgtacaaaagcaaataaaactgctgtaattaacacgctaatatttaatggattcactacacaagaacgatgtgcctggtaaagtctttcatcagctttcgctatatccgatactttcccgtaaaactctgtctgacctgttttcgtttttaaaatgactttatgaatcgttgatgattttcaaaataaaggatgtcactaaaaggaacttgaatatgagcagtttcagttttgtatacaaaagaattttcagctacagtatgatcaatattttcaaaagcatgcactaagacatctgatactgccttttgaaagtcactatcctccaggcctttatctataaaatctaaagcagaaacctgataacgatatgttactggcataaattctgagtgagttgttacaaagacaataacagcataaggatctcgagcccggatttctttagcgatttccattcctttcttttcttctccttttatttcaatatctaaaaagaaaaattgatgattccctgcttcctcaattgattccaataattgatttggtttaccaaaaacttctaggaatttataccttactgacgtttcttcaacacactgcctaatagcattttctaacctgctctgctgaaaaaaatcatcttctaatacaaaaatattaagcattgctatctcctaaactttttgtaagttataatcattattatagcatatttagacaaaagataagtgtccaacttgacttggtagacctgccaatgtataataaacataggaaaaggtagttgctggaaacaactaccccttgcagaaccgtttaagacggtggcttgttataaattattaaaaaataaccgtgaactcgccaaagttatagacggttattttttttgtcgttttcaccaattcaagtactaacatcacgagagcgataacaaagttaccagctacaaacatgagtgttaagacctcaaaggttgacaaagatagcttctcctttctgttagattttgatgatttgcccatagacaccacctacctttcagaaattagagccaccgtctttacttttctgcaaaaactattatagcacagttaataaagaattgtagtccaatttacacatcaaaaaaccagcctacttgggctggtcttcttggagtcgctctcttaggcgacgacggtataaaatctgcgatggaatgaagtaaagaaaacttgccaaaataatccaacgtttatctattccactaaagtaaatcaccaaaatcaaaagaaaggcaatcgtcaaataaaagaaatgatttgtgagcaattttttcatagcatcctccatacctatttttcaatattagtatatcaaaatacacaaatagagtacataccattgccaaaagttttacttatttttcgtatccaaaacaatggtcaccggcccatcattgaccaggctaaccgccatatccgccccaaaaacgcccacttcaacaggcacaaaggctgacaaggcctggttaaaagcatcatagagttggctggctagggcaggagctgccgctcctgtaaaggcagggcgattgcctttttttgtatccgcaaaaagcgtaaattgggaaatggataaaatcttgcccgccacatcttgaacagacttgttcatcttgcctgcctcatctgaaaaaatccgcatattgacaattttacgaacagcatagtccaggtcttcctggctgtcatctggccccacaccgactaggagcaaaagcccttgttcaatttgcccatggatacttccttcgatggtcacactagcctgtgatacacgttgtaatacaattttcatcttatccgttggtccttttcactgagtaaacttctggcaccgacttgatcttgtccaccagactggtcaaggttgccaggttagaaatgccaaaggaaacgtggatggtcgcaaacttcatatccttggttggctgggcattgactgacgaaatattcttgctggcattggtcaaaaccttgaggacatcgttgagaagacctgagcggttgagaccgtaaatgtcaatgtttgccatgtattccttggtcgaattctcatcctcccagtccacatcaatcaagcgaacatcgtagttttcttgactcttgaggttcatacagtccacacggtggaccgctaccccacgccccttggtgatgtagccgacaatttcatcgccaggtactgggttacaacatttggcaatccgtatcagcaagcctgacgctccttcaatgaccacgccaccttcgtgacggattttcagactatctttgttgtcgtgtttgacttcgccaccgttgaccaattcatccgcgacagctttggccttagcccgctcagcttcgcgacgttctttctctgtcagacggttaaagattgatatggcagaaacttctctaaaaccaactgccgcaaaaagggattcgtcggtcttatagctggtcttttgcaggacctcatccatgtggcgacggtccaggtattggttgggaacgtagccattttcttggagtaggttctgaagcatctcacgcccttttgaaacagacaattccttgtcctgattcttgaagaactgcttgattttattgcgagccttgtgagttttaaccaagttgacccagtcacgacttggaccgaaagagttggcagaggtgatgatttccacctgatcgcctgtcttgagcttggtcgtcagaggcaccatacggccgttgaccttggcacctgtcgcccgctcgccgaccttggtatgaatctcataggcgaagtcaatcggtacggagtccttaggcaactcacgcactgcaccatctggcgtgaaaacgtaaatacgctctgtaaaaatatcgtccttgacagaatttacaaaggtttgcgcatccccagccccttcttggagttcaatcaggttgttaatccagcgcaactctttttcactagcagttgccttgccaccacgcttgtaggcccagtgagccgcaaccccgtactctgcaacctggtgcatttccatggtccgaatttggaactcgattggacctctcggtccgtaaaccgtggtatgaatagactggtagccgttagctttttggttggcaatgtagtccttgaagcgacctggcataggtttccacaattcatgaatataccctaacatagcatagacatcgctcggagtatccatgatacaacgaatggcaatcaagtcatatagttgatcaaaccgctttttcttatcgtgcattttgcgatagatagagtaaatatgcttgggtctaccgtaaatctgaccatgtagatggcgctcttctgtataatctcttagcttctcaacaacttcattgaccaactcttcccgttcacgacgcttctcactcatcattcgagtaatcttgtagaattcaatttcattgagatagcggaaagacatgtcttccaattcccacttgatagaagaaatacctagacggtgggcaagcggtgcatagatttccattgtttcacgtgaaatacgttcctgcttgtccttgcgcaagtgcttaagagtccgcatgttgtgaaggcggtctgccagtttaaccagaatgacccgcatgtcttgggacatggctatcagcatatttcggtggttttcagccaactgctcctcatgagacttatactcaaccttacccagtttggtcacaccgccgacaatatggcgaacctctggaccaaattcagcctccatatcatccaaagttacatccgtatcttcaaccacatcatgtaagaaaccacaggcaaccgtcacagcatccagcttgagtcctgctaaaatacctgctacctggatcgggtgtacaatatagggctcgcccgatttacgaaattgtgacttgtgtgcctctgtcgcaaaatccaaagctttcttgacaaatataacatcttcttccggtaaataggtggctgtcaaagcaaccacttcctccccagtgtagttaatttctttcatatctctactcttcctcttatatttcctactattctaccattttcacgaaaaaagaaaaaggaatctaacataagactactaattacaaacaatccaaaccaagttcagattcggtgaacgttcttgttttctttcgttttcttgttattttcactcgtttttcaaacgaacgttcagaattagtcttgaattttgcatttcttagctgtataatgattgtagaagattattacaaaaagaaaatggaggattcttatgaattttcgtttcagtaagtgtgccgtagcactcacactagctctcttagctgcaagcaatccaaaattagctcaagccgaagagattctcaacacaactccagcttcttcaacagaagcaagtcaggctgtaccagttgaatctgacaccacagaggaagctgataatacagaatctccggttccagccactaccgaagctgaaaatccaagctcttccgagacagctgaaactagtgatcctacaagcgagacaactgacacaactacttcagaagcacgcacggtcactcctgctgcaactgaaactagtcagcctgttgaaggacaaactgttgatgttcgcattctcgcaacaactgacctccatacgaacttggtcaactatgactattaccaagataaacctgtagagacactgggtctagcaaaaacagctgttcttatcgaagaagcaaaaaaagaaaatccaaatgtcgtattggtagataatggagacaccattcaaggtactcctcttggaaattacaagtctatcgttgatcctattgaagaaggtgaacaacatcctatgtacgccgccttagagactctgggatttgacgtcggcacacttggcaaccacgaatttaactacggccttgcctacctcgaaaaagtaattcgtacagccaacatgcctctagtcaacgccaatgtcctcgatccgactacgaaagactttctctacaccccttataccattgtgaaaaagacattcacagacaccgagggtaaaaaggttacactaaatgtcggtgttacagggattgttccccctcaaattctcaactgggacaaagcttatctagaaggaaaagtgattgttcgtgatgcagttgaagccgttcgcgatattatcccaaccatgcgagaaaatggcgcagacatcgttctggtcctttcccactcaggtatcggcgatgaccaatatgaagtcggcgaagaaaatgtcggttaccaaatcgccagcctgtcaggagttgatgcggttatcacaggtcactcccacgcagaattcccaggaactgccgaaaaaccaagcttctatgctaaatactctggcgtagatgatacaaatggtaaaatcaacggtactcctgtcaccatggcgggtaaatacggtgatcacctcggcgtcatcgacctcaatctggtctttaaagatggcaaatggacaactacttctagcaaagcggctattcgtaaaatcgatacaaaatcatctgtagcagatggtcgcatcatcgaccttgctaaagaagcccataacgaaaccatcaaatatgttcgtcaacaagtcggtgaaacaactgctccaatcaacagcttctttgcccttgttcaagatgatccatctgtacagattgttaacaatgcacagatttggtatgcaaaacaacagttggcgggtacttcagaagctaatctaccaatcctatctgcggctgcaccatttaaggctggtactcgaggcgatgcttcagcctatacagacattcctgctggcccaatcgccatcaagaacgtagcagacctttacctctacgacaacgttgtagccatcttaaaagtcaacggtgcccaactcaaagaatggttggaaatgtccgcagggcaattcaaccaagttgacctaagctcaacagagccacaaaacctagtcaacacagatttccgcacttacaattttgacgttattgacggagtaacttatcagtacgatattacgcaaccaaataaatacgatcgtgatggtaagatagtcaacgaaactgccagcagagttcggaatctgcaatacaatgggcaagatgtgacagctgatcaagaattcatcgtggtgaccaacaactaccgtgcaaacggtactttccctggggtccgcgaagcttctatcaaccgattgttgaacctggaaaaccgccaagccatcatcaattatattatcgctgagaaagttatcaatcctacagcagacaataactggacctttacagatagtatcaagggactcgacctccgcttcttgacagcagaccgtgcgaaatctctagttactgaccaagaatgtattgtctacctacaggcttcaactgccagcgaaggatttggcgaattcaaatttgtctacactgaatctaaagtagtgactccagatgaacagcagtcagatcaaggtaacacaggtcaagatattgtactcgaatctggtcaacgaattactcttccagcggtaaatccacctgctcctgctccacaacataaattggctagtccacattcacaagcgagcaccaagacactccctgcaacaggagaagctacttctatgcttagtctgctcggtctcactttgattggttttgtcggcgcatggactaagaaaaaagaacattaaaatagacgagactgagcaaaaactagcccttgttcaagcctcattgcttttgactcgtcacgaacctcttaatactcaatgaaaatcaaaagtagcctaggaaacgaagtcgaagatagaactggagttcatcaaggtaagttgacaacggataattttgtttttcgaagagtataaagaggcgttcgtacgacttgtcactataccaatacccttttgcactcaataaaaaaacacagatagactcaagctgattttgatgaaatccagctaagctgtctgtgtttttcttttgctcccattgttttggactaatttcttaaccaattttcgttaatactcaatgaaaataaaaatcagactaggcgacgcagatgcagatagaaccgaagttcatcaaatcaagttaacaatgtctgcttttgattttcgaaaagtataaattcatgctcactaggaggaagcctatctttgtttcaaccctcttttgacctctgcatacgccaaaaacacccttcatcctaccaaatataggttctaataaaacggtaaaggatataaagcaacaagacccaaccaaatatcgtcaggtaaaatacaagactgaatgaatattgctgaaactgctttatttcacgttgactggtctgactcacttcatcagcttcctctattacatctgattcgcgataagcgttgactaacaagcgataatcaaaaggaggaactagtggatcacatgtcaacaaggttaccatatcctgactctcaacaggtaataacttttgccaatctgttgcttttatcacttctgtattttttaccaaatacgtcagcgtcctcccaccaacctcaataaaaatcttatcgccttctctcaactctgacagtcggaaaaatctgagatcattgtaccaactacggtgaccggcaatgacacttcgtcgacctattccacctataggtaaagctgttcctataacagaagcaactccatcatttaaatgttcactggttgccccaacataaataggttgtcgaatttcaatttttggaatactcaaataaccaattgccccttccattaattcagaagataacacatcggtactatttgaatcatttttttctgcaaagggatcaactgtgggtaagtcaccaccactaacctgttccccataagccttaatttcttcgagttgctctgtcgaaaagaatttagaattcctacgataatactgatactgttggaaaacttgaaactcctgcactgacatatttgtcagcaacactaaaggaagcaacaaaccaaccaatatgaaaacatatcctattcttttcatcatttcatttcccccttttgatacttcttcctacggagaagatagaggataataacaatcactactatgattaatagggctaccaagtaggatagcgttagcatatccaaaaagaatgccggtttttgcttgattgcaactttcggttcataaggaacgcgatgtccacgtaccaacaaacgatggctgttaatcatataaggagtacaggttagcaaggttgcatagtcttttccgttttgaactataacaggatcaaaattattcggttcaacaactaaaatctggtccacctcataagccaatacctcagctatattatgaatgtagaattgatccccgacttttaaatgatcgagattggtaaatagcgaagcattaggaagaccacgatgcgccgtaatcacagtatgagtactttctccaccaactggcaaggaggaaccttccaaatgccccgctcctttttgtaatacttcctcagttgtcccagcgtatataggaattctctcgttgattttcggaatttctacaaaaccaattttctccttcacctcaagcatacgagcgtattccactaccccagccttctcttcttctgtgtaaggatcttgcaatttgtgaggttccaaggtctggttgtaggccctagcatgctccaaccttttcagaacttcttcactcggtaactgttgtgcttgttcataaaatgattggattttataatcagagtcataacgataataatattgagaaatccacggatatagcgtcactactaaaccaaagagaaataaaagcttcaagagtatggactgtttagatattccctttctaagttgtgaacgtttcatcattactcgtcactttctttttatttttccgcctttttgttaataagaaaatcagtaaaataccgacaaacattccgagcgcataaagaagataacgaataagaatacgcttctctgcattttcagacgctttaagatgctcttctgcaacataaggaatacgatgaccgcgtaccaataaacggtgcgtattcaccatgtaaggcgtacaggttagcaaggttgcatagtcctgcccaggcttgaccagcaattcctcaaattgagttggttcagcaaccactatttgatctacttcatacgctaatgtttctacgatattgtgaatgtagaaagtatcaccgatttttaccttcgttaagtctgtgaataaccgagctttgggtaaacctgtatgagccgttaagacagtatgggtatcgctccccccaatcggtaaggatgttccttccaaatgccctacacctttttgaagaacggtctcagaagttcctgcataaacaggaagcttgacctcaatttttggaatttcaacataacctatcttttcatgcaattccagcatccgtgcatactctacccgtccagcttcatgtcgtgatttggtatacggatcctccgaaaccacattgttcaaactctcattaaaagcttgagccaaatctattcgttccttaacctcctcagaagctaaggtcttcttttcttggtcgaaagaattagtcagctgatccgactcatatcgataataaaaattagaaacatgaggataaagtaaaatcccaaatccaatcaaaaataccaagtaaaaggggatattacttttcttttttttctttgtagtttttcccgattttttctgtatcataatccgaacttcattattcttccattgtctttctactgcattgcaaagttaatactcaatgaaaaaccaaaagtagcctgagaaacgaagccgaagacagaactggagttcatcaaggctagttgacaacggataattttgattttcgaagagtataaaatcccctacattctgcttttattataccataatccaactttaaaacgaaaaatcccattgccccagattcaacctgacaatgggattttccctctattctagtctgtcaaacgttatcgcttagtataagttaccaagcgataacctagcaagaagagcaaaataccggtagataaaactgcaatcaccaccacatttcctgtatatggaatttcaattccaggaggtgtaacaggtttattcttaatcttaataatctcggacacatgtgaatccgaggttatttcaaaaggaatcgtatcttgagataaaatgtagccagtaggggccttgacctcttttaagtagtaagtaccataaggaagaggacctaccacaaactgaccattcgaacttgacgtgacgtgataagaattgccgtcgactatcacttccttcaattctccgcctacttcctcaagaaccgcaaattctgccccagataaaggggcggtgctggttgatacctttaaaaatggcttgctacccttttcttcgctaggtctcctgaccttagcctcaatctttgtaacacctctacctacattcatcaagaatgggataacttctagactcgtaggctttcctacttgccgaacataataccatcccttagtcaatcctcgaaaagtggcttgaccttctggagaaagagcttgagaagaaattggctcaccatagagactggtcaactcagaccgacttttttgatataaagaatctgccaactgttcagaagaaacgggttcttctgaagcgatgtaccaagcctccaaacccgtcgaaacttgactggcatctattccattagggaaaggaatatgaacctgaacatcaaaagaatcttgtgcttggagtgaaagcgagggcaatgataatacacatattatagcgacaaggcaacatattatttgtcttactgttttcatctgcccctcctttctagtaataattaagcttcttcagattgacgctttttcatcgcgataaaggcaaataccatagtactcaaacctacaattgtgaaaacaagtgtaccgataccacccgtttgtggaatggttacttttttgtttttgatttgttggaagttatctgctgtcaatgcatctattgtaccccatgtatgtgctcctacagtgaattccacaggcgaagtagggagagcgaatccttctggagccttggtttcaataagttcatacttaccttctttaagacctttgacttcaaacttaccatctgttgatgatacaaatgtaaacgcaccttccttagtacctacccaagtccattgcatgttcatcttttcgtaagcagtgtcgcgagcatctttcttctgcttaatttcatcaattttaggattgtctgttgtggctgatttaacagtagctaaataatcagcttccgctgctttataatctgcgatttcttttgcttgtgttactgtatctttcaaagcaagatatgactcttcaccatctttacgaacgatgaactcagcacctagaagtttttcgctactgtccaaatccttatcatctgtcttcacaaatcgtttaccgtatgtgacaacttttggatcttctggtgtgagcggagttggatttggatttttcttgttttctattctgatagtacctgtatcaccatttgaatagctaggaagtgagcctgaaacgattgtttcttcaattacgatgtattctttagcaccatcaagaccagttaattttccagtattaacacctgctgcaagtttaatttcacctacacgtacaccagttcctttttcatatacaccgaatacaacttctgtttggtttacaccagtatcccatgttttgttaacaataatttcaccatcttttggagttgttgattttggctcagagaattcacttggacggttaccgtaaatcaattttacttggttagggatttcagtctctactttcgctgagtcatttaaagtagccttgtaagtcaaggtaaagttcacttcaccttctcttgctttttcttctaatttcgcaagaccgttattattcaatttcaccatgaatccacgtacagtttgtgtcaatgtgtagtctgtatctgctacaaaggttaagatttttattatctgcgatttgtagtgagtttagtttgaaatcaagacctgcaagcatggtatcttcccaagcaaatgtcttatatgctgcgtccttagggacttttgttgtaatagtgtaaccaatttcctgaccgatttcaacattttttataccatcttgatcaacatttgttctcttatcagtgaattctttggtgatttcaggtttgttttcagtattctttggatacacatgaagaggagttttggtatcaaagtatccagaaccatctgttttagcctgtggcaattcaagcttgaatggtacagctttcataccagtaagttcattctgattattgtagtaaggtgaattttctttatcttcagtgaagatataaatgccattagctagagtgaatgttgcaccgttatcttgtgtcattgcagttttatcggtttttacatacttatttgtatctccagtaataccaagttctgcacctgtcttagcttctggagctactacatctgtctttttccatacgtcaaattttactcccgcaacttccacggcagaattaccaaaataattcttcaaatctccgattgaattaccattatatttggataaattttcttcataagtaaatttattgaaatcgtcattattcattacgattttgtgaacaataacggttgtgctagccgtatcttcggcatggactaagtgtttaatatttatcagtgaaccgagcaccgttaggaacacagtaaacactgaaaataatttcgtcaattttttcattgtatactcctatttttatttcttattttatttacattaggaactatctagtatatttccgacgttgctcaacggcaaaagcaatgaacatcatcaccccccctaatgcaatatatggaatgatacccataccacctgttttcggatattctcctttgcggaggtttttcacaataatcaggtgattgtccatattgtctagactgacgaggtcctctccatcttggatagagatagccccatctgcgccaatattaatatggaattctttctcaatcttttgataaccgtcaggggctactatctctttcaagatataggttttccctactgctaaattgtcaaagaggacttcatcccctgttgtagtcgttgtttttacaactgctgtcgcttgaggattgtcactttctcttagttcaaacgttgctacaagacgttgcgtaggatcgctataagaccgtttagcaagtttgatatgggttgtttgttttgtattcttcatgttaaagagaataacattgtcaccatctaccctttcagctaaggtaacctgattatctccattatgaagtttggtcgttccatcatggtttatctggaaacggtatttcttaggatttaattgatatcccgttggcgcaacagtttcttccaaaatgtagtaaccaaaactcaaagatgtttcaaagagaccatttgtcgtcacaccactagcaacttcagtatcctcaacaccatcgttgtttggatcgctgtaaattttaaatgttgcaccatttagaaggtgattctcgtcacgattatctgttttttggagtctgaacttaaattgcttgaagttcttgatggtgatctcaaaggtagcaccttgtgacgtatcaactgtcaccatattcgaatctgactctaaaatttgtaaactaccatctggtcggatttcaaatttggtatcttgtaattgattaacagggcgatagcctcccgtaggaacaactgtctctttcaaaatatagacgccaactggcaagttcgagaaggtgatactgttgtcagcactatttgtatcccccttcatattaacaccatcaattacaactggatgaccagcctctgtaacaagttcaaagcgcgcatttaaaccaagagtcggatggtgataatcacgttttttgattttaagattgtacctacgctcgttatttttcactttaatgctaatcgcatttgcaagagcaccactaacaccaggtaaatctgttacactaaccgaattagtttgacttaaaactctaaaacgtgtcacagctttctgttgcgttaccgcataagcttgcgttgtttcgtataactccaacaataccggtgcactcaaaccgtcataaccttctggtgcttgtgtctctacaagaacatatttgccaagcgctgtcgcagttaatcgtgtcaaactgctttgacctgtaaatgttaaggtttgtacgagattggtatcgtcaagagaggtacttgatacagttgcctctgttgtactatcgtcaactttatagagcttaaaggtaacaggttttgagatttgcttattattcgcatctactttctcgattttgaactctggattttcgatgttaccgattttaataacattagcggcagcatcacttccacctgcttcaatcgtttgggtagcatctcgaacacttacctgcaattctcggattcccaaccatctattcgttcccgtctgtagattccgtacacgaatgtattgagcatagatatctacagtctgagtaaggtcggtctcggtgaaattaccaattgattgataggtgataccatccggtgaatactcaagggcatagctatccatcttgtcatggtcactaccgtttgtggtatttttaccttgagcaaagcgaatttgcgttacgcgctgaggcgaacccaagttcactccccaccattgtccctcattcaaagtcgaacttgggagttggtacaaggcaccggttgtcaaatcaccgtccagcgccttatcttctgtactagagccataggtagaggccatagcaatctctgcagattttatcacatgcaaaccacgtgctatgtgactacttatatccgagtcagaatagaaacgcacgctgccatctctattaacataaatcgtgtagttttctgtcgatttgacatagccagatggagcttgtgtttctgtcagagtatagaccccaggctggaggttttcaaaaacaaagtcttggtttgcagcttgctgtttgacgataggggcaaagtttacatcgtcattctttgtcaaagtaaaggtcatttgtccagtgataaggttggtcaaatcactaatccctttaacacgcttgctaactttgaattttccgagtggatagttcttgacttttatcgtaatcgtatctggcgagctcgtcgtcacatcaataccttcaagataatcactattcacttctacgataccatctgcccgaatagtgaatggtaccaaacctgataagccaatataacccgatggagttttttcttctttgatatagtaagttcctggggtaaagtttttaggaaagctaaattctccattgtcaaagtttgcaatttgcccatcaattacattcccttggctatccgtaataccaatacgtgtctgcacagttactttctgtccagtcagtgcatcaattttctgcactttaactttataagttggagggcggttaataatacgctcactagtaccagattcaaaactgatagttccagtctcagataccgtaaatcgtgccgcagctgttgttaacttactataacctgctggcgcactagtttcccaaagttcataggttataccaccttgcaagtggtccacacggagcttgccttgactatttgaagttaagcctgttagaactcgtttgtagcctgtttgggttatctgacgaagctcaaacactgcatctgcgagtggctgaccttgctcatttaccttggtgaactcagtactaaagtcctcgtcaacaacatttatactaaagtttccgttgacaacttctaccgctcccgtctgtgtattggaagtgtctgttaatttacgtacttttaactctccattttcctcataaacctcaatatcaagaggaggaatcgttttataacccgcaggagcttttgtctccgtcaaagtataaatgccttttgcgaggttagagaaaataaactgacttgcaggaagaacatctcctattgtgacatcataatttccaccatttttactttgcagtctaaagacagctcctttcaatggcttactttcaccaaattcaaatttattgatttgaagtgtagttgatttagtattaacaacttctgttggcttattgacatcgtattttttcccatcaatggtaatattttgattatcggttacaacaatagtgtgctctgtcggatctaagatataaccagatggtgcactagtttccttgaaggtgtaggtgccgccgattatctccgaaaactgaatatctccattatcatctgaaactgcggttcgatatggttcatttcctttatataatgtgaaaatcgcacctgaaagtggaattttctgaccatttttaattccaacctttttcagtttaaaaccataccaatctacaggataagcaccaccttgtgatactgtatctccctcacgacgatagatattagtggttcttcctccacccataactggactattccatggtacactcataccattatagtacagaccatttttctgaaactttttccgttcttttagacggactacaattgctttattacctagtttccaaccttcttgataaaattcgattgtatgagtgctttcaaatccatcaaaagccggataagaatttctctcagaataaactcgaacagatattccaatatccgtacctggtaggtaataatggtggatattcccattatttgatgttcctttataagtgagcttttctaagctatccttagaataggacatagccttggtaccatctgctacatagagttcgatagattgaggaatactatttgctacatttccatttggaaacaactctaaacctggatgaagaaaatcataaaattttctcctattacctagacctcttaatcaatgtctgattgcgagtagtcgttgtataccactcgggaaggtttggaagcacccctgttttatatagttctgtagtctctctattattgattttgatcacattactggttggaactccaatctcaaaccaaccattgtactcttgtacggaataagcctctgtagtcagtacaaagcgaattaaattatctttttcgtgataaacttttgctatcaccttaccatttgcagacacagtggaccatgcaacattaggatttgcaacatgacttaactttaactctggtggcaattctaaagtaaatgaatctcctgcacgcgcaaaagcaggtattttcaagttcattttcatcgaaccgtcaaaaccaccccaaattttagaacctgatttatacatgacatagttgatgcttacaaggtctatactgcttaccccatagtttccgcaagtatctggtgggaatactggtgtcgtggtattatcctttttatttgtaaagacatagtaaagattttcccagtcagtctgtgcgctagaaagaatataacctgatggaacagcttcggtcacatcataatatatcctctttttagttgctgtgcttctcataccagaaaacttatcaacattagcaatcgtaatttgtgtattatttgcgctaagtgtttccttacgattagttaaacttcctccattaaccgtaaaggtcacgtctaccttatcactatcagcctcccaattcttctggatttttatatcacctttcagcgcttctagttgtgctcctgaaatggtgtgattaactttttcgtctttcacatttgtcactgtcttaaccaaagcgaccgcacctgccggaacattgtcaaccgtaatctggttcccaggcgtagcaaccttttcagctttagtttcagtataagttccattacttggttcatatatataaaccttatattcatgggcagcttgtgagctatctagagcaacatcaaatgtaaaactttgggttgtcgacgtatcatttagttgtgaactagtccattcgatgaccttatcgtcattatcacgatacttaccaattgtacgattggtattggaagtattgaccgtatctacttttaagtcccctagaggaccaccatcatttttagctggaagcgtaatagtatctgctgttgataaggtacgtgtttccttctgagttaaggtaactgatgtgccattataggtaagcttgctgccctttggagcatcaacagttacttccgaccgataatccaaactatagttatcacttggaatcaccacaggagtctcaatcgtatagacatacgtcccgtttccaactggtaaattatcggtagctgacttaaaattgtcgaaatttccgtagtaagtcgtattgggcgttattgcaactccatccttcatgatagaagtaattttaggttcacccaaaccagagtcagttgttgttgagaaggcatttctaatggaggtgatattgctattgacaccgcctaccgtagtagtgtattcccaaatgatttttgttgtattggtatttgagtcaaccactacctcttttttcttcaagacaccatcttgtgaatagctttgataaacacctggaattgaaattgtaataggtttaaaaatgtattttatgtttgactcttcacgcgtgatggttgttgttttattcccgaatacggtggtcgttgtagtggcatttgcatttcctgtcacagtaggattatcaagtaatgaagtatcaagtagcgaacgtgctactctcgctgaacgcggtatcaaagatgaatccaatattgagttcagcataagtccttctaaaggatttttaggggagttgctaattgagacggtttgtcttgattgagctactgttaactccactacttcttttgtggcagaaatctcatagccatctatggtagatttttgaattaccgcatagtttcccaacggaagatttgaaatcgttaggagaccatctttatctgtctgaccagtataaacaagattttcactttctacattacgcacctcaaatgtagcaccttcgatggcttcattttcagtatcctcaatgccctcttcttgttcagaactagattttgttaatttgatacagataactcctcgttgttcgaccaaagcatccaccgcttgctctgactctggaactgttgaacttccttgtgattctggattatcaggtacattttcttttgtttcagagacgggtgggtcttgagaaggacttactacattgacatcctcagtagatgaaggcttttcattaacttgagaatactccttaaagacactcggttcagctttaaaatatgcgatatgttccgcatctactaccgctactaactcccccttaataacctcactgaccttggtaaaacttaaagtcagacttacattatctgccgaataatccaattctgttgttggcagcagtctataggaatggtagttttctccatacactggaagttcttctacagtctttgacaatacatctaattcatttgaaagagagcgtttttctgtctcactctttgttatagctaggtccttctcgttatatgactcatctagtttccaacctttttctaaatcatctttctttaactctagccctttttgagtgataactactatacctttttcgttaaaattctgtgtagctaaactctgcttatctattgttattttttgacctatagtctttggactagacaacgattctactaactcaatatttaatctatctttgtcctcctttttgtcttcgatataggtgcgtcttattgttgaagcaccatcggtcgacaaactttctgccatgatatacatcgcatctgtaaaactatacgtgcatagaaaaaaaactgacattaaactagctaattgaactgctttctttctaaattctatcatctcgtactccttggtttgtgtctaaatctgctaaagttgagatacagggacattatctttttcggttctaaatataaacaaaatcaactttaatacttattaagcttacatgaaattgatagttcaaataccattatttcaatgcactataatataaatagcaatcgccgtaagttccctgcaatcttcctctagttttcactttttacaataacatttacacagattttttccatatacaatcttacttgatttccctctaaaatcaagcgacattcagcgataaacacagaaaaaatagaaaaagaacatctggaaatgacaaaaatcaccttaatataaaaatgaccatatttcaaaaaatatgcatcacaccatattacatttcaaacactgactctctaatgagtctaggacaaaaagatttgtttttttgaaatacctcatctggtcattctaccgattgataaacaaaacaaaaaacgaacaatactagtttctagataccttaaaactaattttgttcgtttttatatacaaatttttaatttttctcaaaatcattaatagactaattttagattcgattgaataaaagatgtagcttaaatatttcggcgacgctatttctgttgccaaaaactcggatttgtgagctattatatataagtctgtcctaaattgtttttcttgataaagaattcccgaactacttaaaaaggactttttacctttttagcctaatatgcatgaagaaaaaattactcacaggcaatctagcacaaataatagcgcagctaggtaaaaagtacaacgccacttctttaagttagtgtcaatatctcagtgcagtagttgattgctctagcaatctgagagaattgcttgaggttagaaattgaacaaacaaagtttgtgccgagacagcccaagaaactgtttcagcctgaccctagaaatcaaaagtgaggtaaaaaagttggatataggatttgtaaaaaaaatcacagcaattcgtattttatagtcttttaatttacttttagtacgaggcaatgagccgcaggcataactgaagttaggcaaggcgagttaacgaagtaataaaagaaaaactaaatgacgatacactcaaaatctaccctaatcagctatgtaaggatgagaagacggactctactaggaatagtcgtcttctcatccttgcctggttcttaattccattattgaaaccaatcaccatttaactatctataccccaataatcaaaggattctaacaggttcaagaaagactcaaacattccccatcgtcagtcccgactgatgccgttctttcagtaaatggccaaaccaagatcctagcaaacctgctagggcaatggccaaggtatttataatcgtccctaaggcaaacatggactacctcaacaattccgtcgcataactaatggtcgaaagagcataaagcggagctgtttccgcccggagaatgcgaggacctaggcctgtcttgaccgctcctgctccttcgaaagcagctacttcctcaggcgacacgccaccttctggaccgacgatgacaaggactgattggccgatttctaagccagacaagattttcactagattggcttgttcaccttcttttgcagcctcttcgtaggctaagataatctggtcaaagcctgctagttgagctaggaaatccgattttttctcaaacaagcgaacagccggaatgcgattgcgtttgctttgctcggctgcgccttgggcaattttttctaacttttctgctttttttgccagttttttaccgtcccatttgaccactgaccagtccgctggaaaggcccagagggctgacatgcctaattccgttgccttttgggcgacaaattcgagcttatctccttttggaaagcccatggcaatggtcacggaaatgggtaattcgacattatctgtcagttcttcgatgatttcaacagactggctctggctatccaccacacgcgccaagcgtttaataccgtcgtcaaataccaaaacaatttggtcacctgcctgcaagcgcatgacagaaaacatgtgcttggcagtgtccttatcgctaatctggaacatgccctgcggtgctctgccattgacaaaatactgctgcatcctagcctccaatcacacctgagcggtcagccgtcttcttaaagacgcagcaattccactcgccctgggtcatgtgagtctcaaggaagaagccagccgcctccgcagatgctcgcaccatgtcccacttatccgcgatgatgccgctcataatcaggtagccctcgtccttgaccagacggtaggcgtcctcggtcagatggatgagaatatccgccaagatgttggcaacgatgacttctgctttaatgtcaatgccacgaagcaaatcgcccgctgcgacatgaatattgctagtattggcgttgaggtcgatattttcctgggctacacgcaccgccacctcatccaagtcataggcataaatctccttggcacctaggagggagctagcgatggaaaggacacctgaacctgtgccgacatcaatgactgtctcgccaccacgcaagacctgagaaagagcaaagaggctcatcttggtcgtcgggtgggttcctgtaccgaaagccatgcctggatccaagcggataatcttctccccagctgtcgcctcatagtccgtccaagacggcacaatggtcaaatcgtgggtaatgcgagctggctcatagtatttcttccagttgtccgcccagtcttcctctgccaattcttgactttctagactgatctgacctgtttccaagccaaagcccgtcaaatccgccaagcgagtcgccaagtctgccttaacttcctcaatatccacagtatcaggatagtaagccgtaatcgcaatcatatccgactgctccacctcgggatagagttcgccgaaacagtcttcctgtcccacatagtcagccgagtcgctaatggccaccccctgactgcccgtttcaatcatgagatttgaaactgcttcttctgcatcacgatgcacgtgaatcgttaattcttgccatgagttcatgtttgttttccttttcttttctatcgtcaatcactgtattattgtaccgatttctagcccattttacaagttaatattacgcgatggagccctaataatactttttcgaaaattttctaatcgcactgcgaataaacatgtgtaggaaagtttgaaacggtggttccaagtttctgaacggaggtgatgcccatgaaagtggacagcaaatctgctagggcacgcactagctcgagttttgaaaaatatcgtttcaaaactctcacgtcggaaatctctggatttatatttatcaggtctgcttgttgaaaggctgagcttgataatcgtcatcattttagctattcgagataaaaaataaccgtcagcaaactttgacacagttctgacggttatttaatctaacgaactgaaccaccgtttagcggtcctactgggcgttgagctggaactcaacgccttttctatttttataatagcaaaaatttcgcctgcagtcaagcaagagagaaaacagaatgtcaaatagaatctattaccctcaattctatacccactgcaccatactgttctaattgttctcgcgaataataaacttccatatcttctggtttcgcctctctgatactgctttgcgtatacccacaagacaataaatccagttctttgtataactgagcaaaattatcaaatatgtgaagctctaatacttgcacctcgatcgtttgcgtctgattttctgtacaataaaaacggatgcgatctccaatttgtatatgcttgcgcttctcgtcataaagtcgtagctcaatggtcttctgaccagacttcatcatttcaaaaggttttggagccagtaacatttcatgaaccatctcaatacctcggatatgggtaaaattccccttctaccaagtctgctttgcctttttcaaaagcctctccatcccaagaaatcgcaaattcttgggcttctgggtccgccaaaaagtccatgagatcatctaggccttggtctgcggtgtccttgagaaagcttgcgaaataggtcagaaattctgctgaaaagcccttcttggcgtcaaatggcagagcgaccagatagtcttcctcgtcaaagcgagacttgtcctggttgtagaaaaggacatactcctctaggaaaatatcctcagaagacgcattgccttcgtcgtccaccgtttcaatctcagccgcattttgtgcttccaagataaaagccaactcaatagcatgatttttcttgtcccagttgagctcgtaatcataagtaaaatgtttgtccagtgccgcttccagcacatctaaaaagccatgttttgccattctatttcctcttttctataaattccaataaatttatttctcgaccgtatttgacggaagcccgctcatctttctccaaaatggacttggttaaatctagttgatttaccgctgctaaggctacagcatagtgaataacatctgctaattcttctgccaaacgagcagagctgtcgtcttcgctatccatcatcttgcggcctgcacgttgattcagtagctctgctacttcaccgatttcttccactaatttcataaagagactttgctctggaactgtcgtcccatagtggtcacgcaagtattcttccaaaacactcactgtcaactccgtcatcttcgtttctctccaaatcctaaaattgtagtataatgattataccataaatgcactgaaaggaagcctatgccagccaatctcgcccttcgtatgcgacccaaatccattgatgaggtaatcggtcaggaacacctggtcggtcctggaaagattatccgtcgcatgatcgatgccaatatgctgtcgtccatgattctctacggtccgccagggattggcaagacctctatcgcctctgccattgctggcacaaccaagtatgcctttcggacctttaatgccacgaccgacaaccaaaaacgcctgcaggaaatcgctgaagaggctaagttttctggcggtctggttctcctgctcgatgaaatccaccgccttaacaagaccaagcaggatttcctgctccctcttttggaaaatggcaatatcatcatgattggagcaacgacggaaaatccatttttctctattttacccgccattcgcagtcgagtgcagatttttgaattacaacctttgcaaaccagccatatccgacaggccttggagttggctttgacagacagcgaacgtggttttgacttccctattaccattgagcctgaggctctggattttctggcaaatgcgaccaacggtgaccttcgtgccgcctacaattcgctagaactagctgtactttcgaccaaggaatgtgacgacggtagccgctacattgatctggacgccgtggaaaatagcctgcaaaagtcctacatcagcatggacaagaacggcgatgcccactacgacatcctctccgccctgcaaaaatccattcggggtagcgatgtcaatgccagcctccactacgccgctcgtttgattgaggccgaagatctgcctagtctggctcgtcgcttgacggtcattgcctacgaagacatcggcttggccaatccagaggctcagattcatacggtgacggcccttgaagccgcccagaaaattggctttccagaagcacggattttgattgccaatgtggtagtcgatttggctctttctcccaagtccaattctgcctatctggctatggatgcagctctggctgatttgcgaaagaacggtcatctgcccattccaaatcacctgcgagacggtcattatgctggtagtaaggagctgggaaatgccattggttaccagtatccccatgcctatcctgagaaatgggtggaccaacaatacctgcctgataagttacttcatgcggactacttcactgccaatgacaccggcaaatatgagcgtgccttgggcatgacacaagaaaagataaaaaatttgaaaaaaaatagacgccaaaatccttgatagaactggttttttggcacatacattttgacaccgcttacatttttgccatttttctcttgatttttcaaaaaaaagtggtattattaaatcataaataagaactgctgtggtatacgaattcatacctatgtgttgaccgactatttttgtattactagggagacaaagatcctctaacagtatgcaagctggcacacccagaagcaactaagttagaaacgcgtcacccacctgcttttagcgtgcgggatcaatacaatccatggataaccggtaccaatacagcatttttattttttaccttccttagctcagctggcagagcagcggactcttaatccgtgggtcgtaggttcgatccctacagggaggattggttgatatgaggaaagtcttgatttatcaaggctttttctcgtttttttgagtgaatttggtcaaaatttggtcaaaaagaaccttttcacattgtgaagggctatttttttaacttatcccacaggacaactcgtttttcctgtaatgatttctgtacatcgatgatgcgttgattcgatgagcctcgaaattgcagcataagattgcgcttggtacggtcataacggccgtcaactagaatatctaaataggatagtaactctaacttatccggagtttctaacatcatttcttcccatgtgtagcctgtccaagaccaaatgtccttttctggcagttctttccgaattcgctttacgagtgggaggaccgtgcccgtgttcagaaaaggctcgccacccaagagagttaggccctgtacatagggctgggccaagtctgctaaaatgcggtcttcaagctccttggtatagggaatcccagctttaaaagaccaggttgcaacattgtagcagccctcacagtgaaacagacagccactaacatatagagagcaacggactccttctccatccacaaagttaaaggctttgtagtccattattcgcccttggctaagttcctcgctcttccattcttgtggtttaggattattcatttcaaatacctgagcataagcaaatgaaatctgatcgtttggatgaattccgttttaccagtacacagactgtttttatccataaatggtacttccaatgctttagctcggattgatcccagcaagcttagtgcggaaccaatctcaattcctttcctgttttgattcagcagtttgtcactcccattaatcctcaatccagtatctttctactccgtctcgaacatcttccaaaacgccaccacaagccacaatcgtgcaacggctggcttgattgtctgtcaagcaagtcacaaggaccttggaaatatttttggttgcggcttcctgcaaaccaagtcgcagctggtccttggcatagccctttcctcgctcggttgggcgaatggaatatccgatatgaccgcctttattgagcaggaaatcgttgagccgtaggcgtagactgagaaaaccaagggctcgaccagtctggtcaaatgacacatattgaatggaaggaacaaaaccgtctggcagattgagacctgtctcatagtctttgtttctaaaaatccattcttcaaagtcgacatctttagagataaagcctccgtccatagctgagcctgctttttcaaattctgccagcatctccaaaatcgtttccttatccgctatagtcggtcttcttaattccattttagtctccatattgtcttttgaaaaattcactgatgatgtctatatccagtcccaagtcctgcacaatttctgccttgtggaaatcgtcatagttgtccttaccgctccaaacaaaagaattggtcacaatctgatagtccttatctgactcggctgctctgccattgaccacaaaaccctcactgcccgggacaatgccccacatctgagggtggagacctgtctgtatactggagagcaagtctctgcccttgatacgaactaagagtactcgcttggaaaagggcaagaccttgaccaagtccgaataaaagattggtcccgccgacaaggaagcccgaataccgaagccgttgatgaccgctccatccacctgcaaacctagttgactcgcctgttcaaataaagcctgacaaataacaggggccagagttgataacccttgacgaatgctgtctcgctctccgtctagtgcctgaggtaaaatcgctatcggttgggaaaaaactgcgtcacgttctgatttcatctggtcgataatagccttgaccgccctgtcttcttgggtcagtttctccacctcaatcaagtcataagccaggacctcgtgccgtccgtctgcataacaccgcagggatagatgaccgataaatctgccatattgcccagcctggcaaatactgacgctccctacttgagttggctctttcaagattgtatgagtatgcccacctaaaatcacgttgagttcagggaaatccttggccaaatgcacatcctcatcgtatcctagatgactgagtaagaccatatgagcctgtggatccttggcaagaacctgatccaccactcttcgtagagcttgtttatggccttcaaaaatcacattctccgacggtgacgcaacctcctgggtttccaaggtagtcaaaccgaggacatagagggggttcccattcatatcaaattcaaggacatcctcaagcagcaccaattcatcagccacctccacatcccgatagcggagattggaggacacaattggaaactgagcatagtcatccaagcgactaagcaactcatctccgtggtcaaactcatgattgcccaaggtcatagcctgacaaccaatttgattcatcagctcgatttccttgactcctcggtacatattgaaaaagatattacccgaaaagagatcgccgctgtcaaagacaaaggtcggaatacctttttgctcatttcgagctcgaatatccgcaatcagctgggctttctttggaaaattctccatgtaggaatgcatatcattggtatggagaatactaatatctgtatagtccatactattttttcttgttttttgcttgtttgagcaattcctgcacacgcgcttttttatcctgcttcacattagaattcttctcatgatagcgtgtcaccagggccttgcccttatcgtctaattgatattttcccattcttttcacctcattttcatttttgaacctgtgttcatttataacaaacttccacagctacctggaactgtggaagtcctatcttgtttatttatgatttacaaacttgacccgttcatgtgtttcacacgcgctgagatttccttgtgacggccttttaccatcggacgggcctgcggatttcctagatatccacaagttcgtttaacaacatccaccgacttaggatcgctattcccgcaatttgggcacttgaaaccacgctctgttggctcaaaatcaccttcaaaatcgcaggcgtaacaatggtcaatcggagtattggttcccaagtaaccaacacggtcataggcatagtcccaaacagcttccaaagcctttggattttgttgcagtacagggtattcacagtaatggataaatccaccactagcacctacagcaggataaattttctcaaaatccagtttttcaaacggtgttggatttttgcgtacatcatagtggaaactattagtgtaatactctttatccgtaatgtccttaacgatgccaaatttctctgtatccatacggcagaagcggtctgtcaggctttcagatggtgtcgaataaactgaaaaatgataaccatattcatccgaccaatcttcaaccaaggctttcattttcttgataatatccaccgtgaaatcttttgcctctgggttggtctcccattcgccaccgtaaaatacggttgcgacttcatacaaaccaatgtaccccaaagatacggttgctcgacgatttttaaagacttcatctactgcatctgtcttagccaaacgtttgccgaatgccccatattgatagagaattggagcattggccggggttgcctccttaacccgctccacgcggtaaaccaaggcatccttggcaatggccatacgttctgcaaagatttcccaaaacttatccttatctccagcagactccatggcaatccgtggcaaattgacggttacgacacccaagttcatccgaccagatgtcacatcctgtccattttcatccttccaaccttgaaggaaagagcggcaacccattggcaccttgaaggaacctgtcaactcaacaatcttgtcataagaaagcatatctggatacatacgcttggttgcacattcaatcgccaattgcttgatgtcatagtttggagaatctgactccaagttcaagccacgcttaactgtgaaaatcaacttaggaaagatagctgtccgcccttcgcgccccagacccttgatacgaatgttcaaaatcgctttttgaatttctcgctcaaaccatgatgtccctaggccaaaaccgagtgaggtgaagggtgtttgtccattggaagtaaaaagggtgttgatttcatactccaaagactgcatagcgtcatagatgtctttttgcgttttagcacgcgcatattcttcttgcttgtctgctaacacccaatcctcggcgtctttcaaatgcttttggtagttaagttccgcatagggcgccaaaacttcatcgatacggtcagctgagcagccaccatattgacttgaggccacattagcaatgatttgtgaaatctgagccgtagcagtttgaattgattttggactttctacatcggcatttcctatcttgaagccctgtgccaacatccctttaaaatcaatcaaacaacagttggtcattggtgtataagggctgtaatccaaatcatggtaatgaatatcgcctttttggtgggcattggccacatgagctggtaataatttgagaccgatagactttccgacaatacctgctgtcaggtcccgttgcgtattgaacacatccgcatccttattagcgttttcattgaccacagactggtccttgctcaacagcttatgaatttcaaaattaatatcggtagcctgatgacggcgaaaatcacggcgtgttcggtattgaatataaagctccgccaaatcatataaatgagcctttaacaattcctgttcaacgaccgtttgaatttcgtaaatttgaacatctttctcaaatcggcgaccaatttcagccaaaacagcttctaatacaatttttaaacctgcctctgaaacaggatgttctaattcttggtttgcccgctgaagagcagaaaaaatcttatcctggtcaaaggatactgtccgtccatcacgtttcaaaaccaataattctatactcggtaagacattttcttgcacattcatctgacaaacctccaaaattcttcacttctattagtgtagcacttcacaaaacaaaaatcaatatcttgtgtaaaaaaatattaaacaacctatccatgtactatatataggtcttaaaaattctatcaattggaaaacaactgtgcccaatttcaccactcgacaaggatgaattactagattgaaatatgaaaacagattgggcaaaggtctaacttctctatcagaaaacctaaaaaacagccctctaacagggctggctctatgtattgaaaataggctagggcgggtcacccaccaatgtcattaagttaactaacctatcacgttttgtggtaggttagttttttctatggtacactaaaaataaaaggggaaaagtcatgttagatcagattaaagctcacttacttgatagtattaacgacatcgtttccatcgcaaaccagtttgtgcttcatcctgaaaaagattttagtcggaaaagtcagctaactatggaaaccatgattcaagctatactgaccatgggtggtaataccttagccaaagagctacttgatttagatttgcccgtctctcaatctgcctttgtccaacgacggtatcagcttaaacatcaagcttttaaagccctgtttgccaatattacttctaagattccaacatttaaagatctccctatcttggctgttgatggtagtgatgtggttctaccaagaaatcgttctgataaaacaaccacgttccaaactggaccacaccacactccttacactctcattcatatcaatgctctttacaatcttgaacaagagatttatcatgaccttcgaattcagaataatcgggaggttgatgagcgtgcggctttcatcgacatgatggagagttgcccttttgaacaagctctggtgataatggatagggggtatgaatcctacaatgtcatggctcactgccaagaaagaaattggtcctatattattcgtattcgtgacgggaatcattctatgaaatcaggatttaacctccctgacaccccttgttttgatgaagagtttgacctaaacatctgtcgcaaacaaaccaatgtcatgaaagaactgtatcgagacttccctaatcagtatcattttttacctcataatgcttcctttgaccttttaccaaactctagtcgaaaaagtgatccaatcagtttttatgaccttcattttcggatggtgcgtctcgaaatcaagccaggtttctttgagactttggtgacaaatacggattattcaccagaaaaattaaaagatctctatgcctacagatggggcatagagactagttttcctgacctaaaatacagtatcggtctgactcattttcatgcaaaaaagaaggaagggattctccaagaaatctacgctcactttatcaattttaatgtttgtaaatggctaacctcacacgttgctattaaaccatcaaagttaaaacaggcttataaaatttgtttttcagacgctgtttatgcctgtcgaaaatttcttagagaagaactcacttccttccaattagaaacctacattgctaagcatttatccattattctacccaatcgaaccttccaaagaaagataaaaagcaaggcacctgtaagctttacttatagaatatcataatagttaaaaaattgggttaaaaatcttcctttttgtgcgccctaaatacaaaaactattcccgttttgtcatcaattgctcagacgggaatagtttctttagctgcttaaatgcttaacttaatgacattgattctgactcttgttttctggtccataaaaagtacaaattgatggcacaggccactaaaatcacagcaggccaaagcaaatttaacaaaggaagtttaccgacattgtaggcaatatagagagtattccacactacccccaagctatagacaatcgtcaaaataattttcataagacactccaattaaatgatagtgctattatactacaaacgaccattgatgtccttaatctgccgttccattttccgatagtttaggaaaaatagcagagcgtataccaagacaaagatgagccagaaaaagagaagggccccaagtttcacgggaaaccagccagccaaaatgcccagcggtgtaaagcctaaaaccgtgaaaccaaaatgcgttgccgtcattcgtaaaaggctccaatcctgttcaaaaatcttgtctgccagctgaaacaagataccgattgtcgcccaaatggctacacaaatcaacatgacggttacttgactaaagttgctcaggtagtaagcacccatggttgaaaagggatttagaggaaggtaggttccctgtccgaagacggctgatgtgataatggagataatggttccgatggcgatgcctaaactggctgataagatgtattttttcatagtcctaacctttctttgataacttttagatagcgacgggaggagtaggtgaccgagccattcttcatgaccagtttgaccagaccgttagcagtcagtttgaggtggtccagttgcttgatgtgaatgatttccgactgagagatttgtaaaaagtttgccggcaagtcctccttaacctgatacaagcgtaggttggaagtataggtagtttctactgtttccacctgtaaaaccctatcttccaagtagagtctgacaatctcatcatgttccacaagatagacctgctccccttttttaacagttagactggatctctgcttatccaagttttgaatataggtcaccaagttagtaatttgctcagacatagcttgagcttcaatagtcaccaaatcttccaaaatctctgatgatatggctagttttactttcatattctctcctttctctttctgaccctattaaacaccatttctttactggtttcaagggcttttggctatgtggtcattttccagcactaaacggcaaaaaagccagaacaactgtcctgactttcattgtcttatatttttttcttcaactccgccaccgccatcatgacttccataggggtcatattgtagatgtctagtttttccagttcatcaagtactgggtgagaaggcgtgtctgcgaagagatcaagttgacctgacggttcttccactactgacggagctgggtgagttggtgcagtaggggcttggttttcaagcgtctgcaaaatccgatctgcccgctgcaatagttcctctggcattcccgcaatcttagccacatgaatcccgtaggacttgtcagctggaccttgggcaatcttgtggaggaaggtgacttggccgtccttctccaaggtcgatacatggacattctctaagtgttccaaggtctggctaaggtctgtcaactcatggtagtgggtggcaaagagagtcttggcaccaatcttgtcatggatgtactcgatgatagactgggccagggccataccgtcataggtggccgttccccgtcccaactcatcaaagaggatgagcgaccgatctgtcgccagacggaccgccttattggcctccatcatttcgaccatgaaggtcgattgaccactaaccaagtcgtctgccgccccaattcgggtgaaaatagcatcgaaaatcggtaattcagcctgatccgcaggcacataggaacccatctgcgccatgatgacgataaccgccaactgtcgcatataggtagacttaccactcatgtttggaccagtaatcagttgcatatgtgtatcggtattcaagtgaatagagttgggaatgtaggtctgcttgcccatgaccttctccaccaccgcatgacgaccacggtcaatggtcagttctctttgatctgtaaagcgtggacaaaccaaatgttgctgctccgccacaactgcaaaggcctgcaaaacatcgatggttgcaatggtccgagccagcttctgcaagcgacctatatacttctcaacctcttggcgaatccgcatgaaaatctcgtactccaaattagcagacttatcacgcgcctccaacatctgcccttcaatcttagccaactcttccgttccatagcgctccgagtttttcaaggtcgccttacggaaaaaatggtccggcacattgcccagattggaattggtaacatggaaatagtaaccgtcttttttattgtaatcaatcttaagattattgataccagatgcttcacgctccttggcctcaatctccgcaatccaacccgctccctcacgcatgactagacgatactgatccagcgtttcgtcaaagcctgtacggatgatgtttccatctgtgatggtcccttgggcttctgggtcaatagcagagctgatgagagcgtgcagttctgggattgggtccaatccagccaccaaattgcctagagcaggctcattgatttgttgcaagatattcttgattgctgggatatttcccaaagtctgggagagctgcaagagatccttgggcatggtttttccaaaagacacccggctggccaaacgttcgatgtcatagacaccttttaaagcctcgaccaagtcactccgttcaaagaagtaatccagaaaaacctgaacgacagcctgacgattctcaatccgcttaagatcaatcaagggacgatcaatccatgtccgcaatagtcgcatacccatggctgtcttagtttcgtctagcaaccagtacaaactaccatgcttcttgcctgtccgaccgttttcaagcaggtccagactggacttggttgcatagtccatttgcagatagtccttgatttcatagtggaccaccttttgcaagtggctcagatctcgcatctgagtccgatgtaggtagctgaggagtttacctgccgcagccttttccaagtctgtcaaggagttgtcaatcagctggacatcttccgtcacctcatcctcaaaagagagcaggaggttcatctggttcgaaaagacctgctcttcttcctcagataaagcatagccgatgaccaattcacgtgcccgtaaattgcggatctcaccgcaaagactagtaaaatcatccaaactagtcacaaaaaactgacctgttgacacatccatataagaaagcgcgaactgtactccctgacggtcaatcgcaaccaaatagttactgtctgctcccattttggacgagtctgttaccgtaccaggagtaatgacctgcactacttcccgcttgaccacgccgactgcctgcttaggatcttccatctgctcggcaattgcgaccttgtgccccaattcaacaagtgtgtcgatatactgttgtgccgcgtgatacggtacccccgccatgggaatcggattttccgcattcttattccgactggtcaaggacaattccaaaatctgtgccgcttctaccgcatcttcataaaataattcataaaagtctcccatacggaaaagcaaaaaagcatctggatactgtgcttttatatccagatactgctgcattcccggagaaattttttctgttgccatcatctctccttgttctaattcaaatagtagttaatctccgcttcaacttgctgagccgctacatcatctcgacaaataactaaaagtgtattagctcccgccagcgttcccaaaatagtctctggcttttctgcatcaatgatattggccatcaaggccgcttctcccagttctgaatgaaggaccagaataaaactagccctatctactttatacgcatattgtgccaataattggataaaattcacgcgctcttcttcgatagctaaggaataaaatgaacgcccgttttcatgaatttttatcactcccaactcacgtaaatcacgagacaaggttgtctgggttaccactacccctcgagcctctaaaccttgctgaatatccgtttgtcgccctattttttcttgacgaatcatggcctttattaaatcatgtcgtcctgctttattcatcattttacctcaaaatgtatatttatagaaatattataacacttttccccgctattagcctagaaatgtgttaaaatagaatcaataactttggaggaaatcctatatgaatcaaaaacaagtgattgcagaaagattggctgccatccttccgagtttggaagtggaagctatctacaatctgctagaaaaaccaaaatcatcagaaatgggcgatattgccttcccagccttctcacttgctaaagtggaacgcaaggctccacaggctatcgcagcggacatcgttgaaaaactcgatacaactggctttgagaacgttgttgcaactggtccttacgtcaacttcttcttggacaaggctgcgatttcccaccaagtcttgacagatgttattactgaaaaagaccaatacggtaaactcaacattggtcaaggacgcaatgtaaccatcgacatgtctagtccaaacattgctaaaccattctcagttggacatttacgctcaaccgttatcggcgatgcccttgccaacatccacgaaaaactaggctacaagccaatccgtatcaaccacttgggtgactggggcaaacaatttggcatgttgattgttgcctacaaactctggggtgacaaggctgcggtcgaagctgacccaatctcagaacttcttaaactctatgtccgtatcaatgctgaggcagaagaaaaacctgagttggacgacgaagcacgccaatggttcaaaaaattggaagacggcgacccagaagcgcatgaattgtggcaatggttccgtgatgagagcttggtcgaatttaaccgcatctacgacaaacttgatgtaacattcgacagctataacggcgaagccttctacaacgataagatggacgaaggtatccaaatcttagaagaaaaaggacttcttcaagagtctaaaggtgccaaaatcgttgaccttgaaagctacaatcttccaccagcccttatcatgaagacagatggcgctaccctctacatcacgcgcgatatggcaacagctatgtaccgcaagcgcacctatgacttcgtgaaaagcatctatgtcgttggtcaggagcaaatcaaccacttcaagcaactcaaagccgttttgaaggaaatggatttcgactggagcgacgatatgacccatatcaccttcggtctagtgaccaaggacaagaaaaagctctctactcgtaaaggaaacatcatcctgctcgagccaactctagacgaagctatttcacgcgcccttactcaaattgaagctaaaaaccctgaccttgaaaacaaggaagaagtggcacacgcagttggtgtcggcgctgtgaagttctacgacctcaaaaccgaccgtgacaacggctacgacttcgacttggaagctatggtttccttcgagggtgaaacaggtccttatgtacaatacgcatacgcccgcatccagtctatcctacgcaaggcaaactttgtaccaaacgcagaaaatgactacaaactggctgacacagaaagctgggaaatcatcaagcacatccaaaacttctcagctgttgtagaacgtgccggagacaaatttgacccatcacttattgccaaatacgctatcaacctagctcaagccttcaacaaatactacgcccacacgcgtatcttggatgaaagtccagagcgtgacagccgcttggcacttgcctacgcaacaggacttgtcctcaaagaagctctgcgtcttctcggcgtaaaagcaccagaaaaaatgtaatcaaagccttcggccatcagccgaggctttttttctaccacattgcctactctcgtttccgattccttatcacaacaactccttctcccaaatgaaaatcaaaaagattcatttcaattacgaatatatagatgggaggtacacgtgatacctctacatctactacacaaggagaaataatgaaaacattcttgagaagaaaaggaatcgcctgtcagcttctagccgccatttttattgtcggtatcaatttacaatccccaccttcagcctcagccaatgcaagaggagatgactatccctacacagcagttgatgcagtcgatccatggagactctacacacgccagtgcacctcctttgtagcctttcgacttagcacagttaacggttttacattgccacctgcctatggtgatgccaatgtttggggccatcgtgccaaacaagaaggttatcaagttaatatgacacctgctgtcggagccgttgcctggtgggaaactcccatgcatgtcgcatgggtttctgcagtaaatggagataccgtagagattgaggaatacaactacggtgttcgctatacctacggaaggcgagttatccccaaaaatgccgttagcggctacattcattttaaaaacctcggagcgggaacaaccaactctcaacccgccttagccccaagcggcacctatacctttaccagccaactggccatcaaatctcaagctagtctatctagccctaccctcgattactattatgctggcgaaagcgtccgctacgacaaggttcttgaagacgacggacaacgctggattagctatatcagctattctggagctcggcgctatatcgccatccagcctaccattactcaatctacaaacaacagcctaccagcatcaggtagctacaccatccagtcctactctagtgtccgcaacaatccaagtctgtccagtcctgaaatcaccttctacggagctggctcagtcgttcgctatgataaagttattactgccgaaggtcgcacatggattagctatatcagttactcaggtgctcgacgctacatcgccatctcctaatcacaaaaaatacaatatttaaaagcacaatcttttagactgtgctttttcattaaatatctgtcgaattaatagctgtgctcggtttttctttcggtttacgcagatggaagaagacggtcacaccaaagtaaatggcaaataggacaatgttaaggatgtaagcccctagcatacctgctgctgtcacatcacgcaaggctgcatctgagtagaggttggcaatccccttacctgctaggtagctataggtattcagcagtaaggtcgaaaatagatagccgatgtaaagataagaagccagctcatttttcttcatgaataagaagacaatgaccgcaatcaaaagaccaaacatgaccagggctgctgtcttttgaatgatacccgtctggagattggctgtttctctcgaaacaagaatcaattcttctacatcaatcccaacaactccctgcacagacgtacgaagtcgctcctcattaaaagtcgacacaaaggcactaaacagccttaaaatactggcaatactggatagtatcacaaaaatatacaaatgaatcggtcttttcataatagcctccttttttctatattttatactcatatttttatattgtcaatcatatatttcatttgactgcaaatataattttgttatactaagttcaaaggaggaaaactcatgaagaaattgcccacctatatcggagtgattatttttgtagtcactctactgattaactggttattgccaagtcttgctaaagtgctgaatacatttttcatttggactatcgtagcctgcctactctacaccatctactactggattcgctactggctctatgtccgacaacagagataacaaagactcctctaagttagctgcttagaggagttcattttattatgacttttcatcaaccaaatgcacattaacccgacgataagtttctgtaaggtctagcaattccgcttcaatctctggtgtcaattgatctgccgtcattctccaagtccagttaccaccaagcgtatttggcaagttcatgcgagctgaaccatccaaaccaagtaggtcctgcatagtagccaccgccataaaggcaggtgaaccaaagagcagacggaaaagagcatgactgaccgtttccccctcacgacgattgctgtacttatctaagaatgcacgcgattctttcgttgtttcattttcgtaccagccaagaatcgtatcattgtcatgggttcccgtatatgccaccacattattaggatggttatgtggcatttcaatgctgtctccttctggatcaaaagcaaactgcaggactttcataccaggaaaacctgtcgtatcacgtaattggatgaccttgtctgtcacagagcccaaatcctcagctatgatatttaagtctccgagttcacgtttgattgtatcaaataactcaaaacctggtgcttcgacacgatagccatttacagctgtttcttcacccgctggaatttcccagaaggaggcaaagccgataaagtggtcgatacgtaccatatcgtatatcttaaaggattcacgtaaacgagcaacccaccaagtaaatccgtcatgcttcatcgcttcccaatcataaatcggattgccccaaagctgaccaatttccgaaaaggcatctggtgggcatcctgcaaccacactcggcttgccttcttcatccgttttaaagaaatgtggattagcccacatatcggcagaatcagccgcgatataaatcggcatatccccaacaaactcaacacctttggcattggcataagcctttaaagccttccattgtgaaaagaataaatattgtgtaatgcggtgataatcaattcgatctgccaacaagtgacgataatattccaaggtatcgtggtaacgtaagcgcgccccttgatcttcccactctgtccaaggtttgagatcaaaatgctcttttatagccatatactccgcaaaggtatgaatccaaaagtcattctcccctaagaacatccaataatcttctggcaagccttgtgccttcatgttggcaactaccttctccagtaatggacgtcgagcataaaaaatggctgcgtaatctacctctgtaggattctgcccaaagtcaacaccgtgtaaatcctctgctgccagccagcctttatcaatcaatatatcaaaatcaataaaatgagtattccctgcaaaagctgaaaatgactggtaaggagaatctccataactggttgttcccaaaggtaagatttgccaatagcgttgcttagttcttaccaaaaaatcaacaaattcataagccgattggcccatggaaccaattccatatttcccaggtaatgatgaaatgtgcatcagcacaccactctgtcttactttcataagttctcctatctaatccgcttgcacaacgcaaacgttttctcttttttattatatactgaaaacggtaacaaatcaagaaatttccatttaattctgttagttcacatgccattccatatttcttttcattaatatatgcaaaaaaattcttatatttttttaaactcaaaaaaatttttaaaaatttttataaaaacgcttgcaaacggattcaatctagtgtataatgaagtcaacttaggaaaacgtttgcgcaaagcaagcgtcacacaaaactatttatcttcggagggaagaaaatgaaacacaatctccttaagagcgttgctcttcttgctgcatcaactgctgttttagctgcatgctcaaactcaggttcatcaacagaggcatctaagtctgctgaaggtagcaaagaattgactgtctacgttgaccaaggttatgaatcttacatcaacgatgtcaaagctggcttcgaaaaagaaaatggtgtatctgttaccgttaaaactggtgatgctttaactggtttggataacttatcgttggataaccaatctggttcagccccagacgttatgatggcaccatacgaccgtgtaggtagccttggttctgaaggtcaactatctgaattgactcttgcagatgatagcaaagcagatgacacaacaactgctcttgtaacaaacggtggtaaagtttacggttcacctgcggttatcgaaacacttgttctttactacaacaaagacttgttgactgaagctcctaagacatttgcagaacttgaaacacttgctaaagacagcaaatacgcatttgctggtgaagagggtaaaacttcagcattcctagctgactggacgaatttctactatacatacggacttctttctggttacggcggctatgtattcggtgaaaatggtacaaatccaaaagacatcggacttgctaatgaaggtgctatcaaagcaattgaatacgctaaaacttggtacgaaaaatggcctcaaggtcttcaagacggtactgctgcaaacaacttgattaacactcaatttacagacggtaaagcagctgctatcatcgaaggtccttggaaagcagcttcatataaagaagctggtgtaaactatggtgtagcaacaataccaactcttgtaaacggcaaaaactactcagcattcggtggtggtaaagcatgggttgttccagcaggcgctaaaaaccaagaaatggctcaaaagtttgttgacttcttgactgctacagaccaacaaaaagcactttacgacgctacaaacgaagttccagctaacactgaagctcgtgaatatgctgtaagcaaaaaagacgaattgacaactgcagttatcaaccagtttgcttcagctcaaccaatgccaaacatctcagaaatgggttcagtttggacaccagctggtaacatgctcttcgaagctgcaagtggttcaaaagacgctaagactgctgcaacagacgctgtgaaagctattgcagacgaaattgctcaaaaacacagcaactagtcaagtttaaagttggactgggagttctcttcccagtctactttattacttaacgataaactgaatagatatagtcttttagtttacttttagtacgaggcaatgagccgcaggcataactgaagttaggcaaggcgagttaacgaagtaataaaagaaaaactaaatgacgataacatccaccgtctattcagaagctatataaggagactatgactatgaaacaaaatccaggtaaggcactccttttgtccctgatccctggtctcggacaaatctacaataaacaaaaagccaaaggatacatctttttaggtgttacgcttgccttccttgtttattttattgctattgcagctggtgaattaggcaacttgattaccctcggtagtgttcgtggacaagataattcgctattcatgctgattcgtggttctttccacttaattatcacagttgtctatctcgctttctatgcactcaacctaaaagacgcacgtgataccgcgaaacgatggaattcaaggatgccagtggctaccacattaaaagaaatggtaaaaggtatctatgagaatggtttcccatatctcttgattatcccatcatatattgcgatgacctttgctatcatcttcccagttgtcgttacattgtttatcgcctttacaaactacgacttcaaacacctgccaccaagcgcattgttggattggattggtattaccaactttacaaatatctggaaactaagcacattccgtacagcatttggttctgtacttggctggacaattatctgggcactctgcgcttcaacagctcaaattgttatcggtatcttgacagccatcatcgcaaatcagccattcatcaaaggaaaacgcatcttcggtgttatcttcttgctcccatgggctgttcctgccttcgtaactatcttgacttttagtaacatgttcaacgatagtgttggtgctattaacacacaggtattgccattcctgagcaaattcctaccattcatcgataatttccttatcccttggaagaccgacccattctggactaaagttgccctcattatgatgcaggcttggcttggtttcccttatatctatgttttgaccctgggtattttgcaatccattccaaacgacttgtatgaagctgcttacattgatggtgcaagtgccattcaaaaattccgtaacatcacccttccgatgattttagcagtagcagctccaacactaatcagtcaatacaccttcaacttcaacaacttctctatcatctacctcttcaacaatggtggtcctggtagcgtcggtggtggagcgggttcaactgacatcttgatttcatggatttataaattaaccacaggtacatcacctcaatactcaatggcggcagcagttacattgattatctcaatgattgtcatcagtatttccatgattgccttcaaaaaactaaatgcttttgaaatggaggatgtataagatgaaagtatctgtaaaaactagacgcatactcaatcagaccttaacctatctctatctgattgttctgtctgttatcatcatctatcctctcttgattacaatcatgtccgccttcaagtctggtaacgtggttgccttcaaattggatagcaatatcaactttacactagacaattttagcaagctctttagcgagactctatacggaacctggtacttcaatacgcttatcattgctctcttgacaatggttattcaaacaagtatagtggtactagcgggttacgcttatagtcgctataacttcatcgctcgtaagcagagtttggtcttcttcttgattatccaaatggtaccaaccatggctgctcttaccgccttcttcgttatggccctcatgctcaatgcgctcaaccaaagctggttcctcatcttcctttatgtcggtggtggtatcccaatgaacgcttggctcatgaaaggctacttcgatacggtaccaatctcacttgatgaatctgcaaaactagacggtgccgggcacttcagacgtttctggcaaatcgtcctcccactcgttcgtccaatgattgctgtacaagcgctctgggccttcatgggaccttttggagattacatcctatccaaattcttgcttcgtgaaaaagaattctatactgtagctgtcggacttcaaaccttcatcagtgatgtgaagaatatgaagattgcctactttgcggcaggtgccattcttattgccctccctatcagtatcctattcttcttcctacaaaagaactttgtatctggtttaacaagcggtggcgacaagggataaccctgtcccaccttttccctttttaggggaaacattgatatttatgaaaggtccaacgaatgctcccatatcctttttcctatttttctagtatcttctctccaagaaatatgtttgccaatcgtagactaatgaacctttggcaacggttgtttacaacgctttttttagtggcgctcttgctcattccgagctccctacagactgtcaatctcgaaacctatcctttagaaaatttcgtagaaggtatctatgcacctctgacagatcaagtcgtagatgacctccgtcaacatgcagtcatcgaaaacaaccacctaacctatactggaaatactaactgggagcaagtgacatttggtgataccgttagctctagttctgactttacttatcaattcgccaatcagtctctgactattcgtaaaggaagtgatattctaagcgaattgacttatgaaggtttgaatactgacgattttgctagtaaggagaccttgactgcaaccatctctaaaaaatggtatcaagccaaccgagcagctgtcggactgtccatcactcttatttcgacctttattttaacaacaaacctactcttcatcctactaggagccagcttcttcctctttttgactaaaaagtctcgtttcttccattttgaaacgtttgcagagtgctataattttgctctcaactgtctgggcctgcctactcttatagcctgtctaattggactatttggtcaacctgtgactacccttctaaccatacaaaatatcctatttgtactatgcttgttatgggtatttttcaaaacaaaattcagagatgaaatctaggaggtctatatgcgtgctaccatcaaagatgtggcaaaattagctggtgtctcgccatctacagttactcgtgtcattcaaaatagctctgccattagccaaaaaacgaaagacttggttaggaaagccatggcggatctcaactaccatccaaacctcaacgctcgaagcctagtttctagctatacacaggttatcggactggttttgccagatgactcggatgttttctatcaaaaccccttcttccctactgccttacgaggaatttctcaagttgcggcagatcataattatgccatccaaatctccacaggaaagaatgaagaacaacgtctagaagcgatttctcagatggtctacggcaaacgagtggacggcctcatcttcctctattccaagcccgacgatccattggtacaattagctatccaacacaaattccccttcctcattcttggtaaggcggattctccattcatatcactagttgataatgataatatccaggccggctttgaagctaccaactacttcatcaataaaggttacaaaaacattgccttcgtcgctggtaacaaagagttagtcgtatctcaagaccgttatacaggttacaagaacgcccttaaatcgcacaatattcccctggatgaaaacaaggtcaagtttgtgtctggcttccttctcgaagacagtgcctacaaaatttctaagaaattactcaaacaagacctggatgcaatcgtcacaactgacacttccgttgccgaaggtgttgtcaaatatctcaacgaagtcggagtcaaacttcctatcatttcttttgactccgtcaagccaaaactagatattgaagcctacgttgacgtccacgctattaaactaggacgcgtcgcattcaacactctgcaccaaatcatcaatgacaacaaggaagacaagcaagtctgctaccgacgtgtcattccacataccattaccgaactctaacttagaaaggagccttttggctcatggcattacgacaatttcaagcatctcttgacgatgtagcaactattcgcttggtcatggaaaaacgattcgactccgaacatatgagcttctcacttgaatcaaatgatgctacatctcaactttttatccattcctgtctagaagtagataatctcgtcatctattatctaaccagcctccatgcactgacattggacaaggactataccatctacgaccaagaccgtaataaaacagaactcggctatggtcatatcgttcgctctacactttttgaacaaagttatacatacaatggccaagatttgggagcaacctatcgaccagaggcaacaacctttaagttatgggcacctatttctaagcaagtttttcttgttctagaaggaaacccacatgcaatgacgaagggagcaaaaggagtttgggaaattactgttgaaggagacctagaagcgcacagctatcactatctccacaaagtaaacggtgaatggatttccgttcacgatccctacgccctgtcttccacagccaactcaggtgacagctacgttatcaatccagataaacttcataaaattcgtcgtgctaagacccaacgacctatttctcaggccattatctatgaaatgagcgtccgtgatttctcatggcaaaaagaagctggtttcaagcatcgcagtcaatttctcggcttgacagagtctcctaccatggatggaatgaagctaggaatggattacatcagagaactaggcgttacccatattcaattattgcctgtttatgattttggcagtgtggatgaaaataaaccccaagctgtttacaactggggctacgaccctatgcaatacaatctgccagaaggttcctattctagccaaccaaacgatccttacgcacgtattctagagctacaagaagctatccaggcctaccatgatgcagatatttcagttattatggacgttgtttacaaccacgtctatcatgctgaaaagtacgcatttgagctcatcgttccaggctacttctatcgctatgatgaccacggcatgcgaacagacgggacattctgcggtaacgacgttgccagcgagcgcagtatggtccgcaactacatcaaacaatcccttcgccaatggctagaactctatggttttgatggcttccgtttcgaccttatgggtattttagatagcgaaacaatcaaccagattcaaactgaattatctgccattcacccaaatgtctacctctatggtgaaggatggaaaatggcaacaggcctcgaatttgaaaagctggctcaccagtacaatgcagagcatttacctgaaatcagcttcttcaatgacgattaccgtgatacctttaagaaactcttgctcaatccaaaccgtctaatagataagcaattgcacgaaaaggtacaacatctcctgactggtagccgattaagccatttcttaacgcctcaacagtccctcaactacatcgaatgccatgataatgctacagcatttgactatttccatattgataatccaaactggacacctcaacagcagaaacgtgctgcaagttttggtctccagctcatcttaatctctcagggtatggccttcattcacagcggacaggaatttttccgtacaaaagatgaaatagataatacttacaatatccctgaccgtatcaaccgtctggactggacacgagctattcgttataaggaacatatcgagttcattcaggaattaattaccttccgcaaaaataatccaatactcagccaggataactacgaaagtatccaagaaacttgtgatttctactggttaactgaatatgttcttcgctatcaagtgacaagtgaagaaaagaccattcaatttatcatcaactttgcagatagcgactttacctatgaacgtgaaaaagataaggcagttctctacaactatcctccagtcgaagagcgtgatcagcaagaaatcacgattgcaggacagagtatttgcattttagaagacaaataggactttagaccgatgaaacacgatatagtctgaggtatactatagtcaatcctaaatatttttcataatctccttaaaactcactagtcactctggtgagttttttttgtgtgaccaaaaaaacaacccagcataaagctgagttgaggctctttacatcaattccattatcttccgaccaatgcgttcaatgtcattctgcatccctctgagttcaaaggtgtctataacaggaaaattaaatcgctcagcatattgcttggcagtcagacaatattggttgttaaaattgcggttacctgagccaacgacacccagacagagctctgcattggtccccaaagcgataaaatctccaagaggattggtcagaatttccacatctccgttgtccactccatttccaccttctaagtaggttggtaaaaaggcgacaaagggtgcatctagctgatagaaaggaatagcctgcttgaccaaatctttgacatgaactagctcaatctcccagtcagtttgaaattggaaaaaggactttagacgtttcacaaaactctctgtattgccactcaaactgatgtaaaccaaatatattttcttcttcatacacttcctctttataataaaaacactacatgtagactgtaaatactattttactcctacatgtagtgtttgtcaatcagtcgctttccacaaaccgaccaataatattgacgttgtcagctaccgatacaaaggctttggggtctgcctttttcataatatgcttgaaatcattaaactccgcacgagtgatgatggtaatgagaatcgtcttttgctcatggttataagcaccctcagcaccgttgataatggtcacaccgcgattgagcttcttatggattttcttaatgacacgttcaggatgattggtaataatcatggcctgcatccgtttttgtttcacgaaaatcgcatctgtcatgcgactggagataaacagcgcaaccattgaatacagggcatattgccagccaaaggtcatccctgcaatcaacataatcataatgttgacaatcaaggaaatagagccgacttgtcgtcccgtcttcttgcgaataataatagagacaatatcagtaccaccactggatacattgttcctaagtgcaaagccaatcccagttcccagcatgagaccaccgaaaatagcattgactaacggatccgtcgtcagggtaactggcggcataaattggataaagaaagaactgaaggataccgtaataaaggtaaagatagtaaatttataaccaattttataccaagctaagataagcaagggaatgttcaggccgtagtagaccaccgcaatcggtacattccaaccagcgtaagaagctgccagagcagaaacaatctgtgcaagaccagtaactccagacgaatagacattccctggtcgaaagaaaaaattgactgcaatactagataggagtccataaataatggaccccgatatccgttcagcatatttttcccgagaaattcccaaaatgaccgaccaaaacttattctttctggcctttcttaaaaagcgtacacgctgttttctgaaaaatttattcattttcaagtgtaatgtctaaagccaattcctctaattgagctgatgcaaccgtacttggtgcctgtgtcatcggatcagatgccttgttattcttcggaaaggcgataacttcacgaatgttatcctcaccagccaataacatgacaaagcggtccaacccgatagccaatccaccgtgtggtgggaaaccgtagtccatagcttctagcaagaaaccaaactgctcatgggcatcttcagctgagaaaccaagagccttgaacatctgttcttgcatgtctttttggttgatacgaaggctaccgccacccaattcataaccattcaaaacaatatcgtaggcaactgcacgcacctgcgccaaatcaccatccaaatgatgagctgtttcttccgtcggcaaggtgaatgggtgatgggcactcatatagcgaccttcctcttcagaccactcaaacattggccaatccacaatccagaggaagttgaacttgctttcatcaatcaagccttgctcttttgccaagcggttacgcaaggctcccagggtattgttggctacttccaattcatctgctacaaagagaaccaaatccttgtcttccaactgtaaacttgctgtcaatttttctgtaatacccgtcaagaacttagcaactgggcccgctaattctcccttgtctactttaacccaagcaagtcccttagcaccaaattgttttgcgtagtctgttaatttatcaatgtctttacgtgagtagctatccgccgcacccttgaccacaatggctttgacaactggtgcttctgagaagaccttgaagtcaacttccttgacaagttctgtcaagtcttgcaaaagcatctcaaaacgagtatctggtttatctgaaccgtagaagttcatcgcatggtcataggccatacgtgggaatggcaaggtcacatcaattcctttggtatctttcaagaccttagcaatcaagccttctacgatgtcttggatttcaacctcattcaagaatgaggtttccaagtcaacctgtgtaaactcaggttgacgatccccacgcaaatcttcatcacggaaacacttaacgatttggtagtaacggtcaaaaccagcgttcattaaaagctgcttagtaatctgtggactttgtggcaaagcatagaaatgacctttggacacacgagatggtaccaagtagtcgcgcgcaccttctggtgttgacttggtcaacattggtgtttccacatcgataaattccaaatcgtccaagtagttgcgaatgctgtgggttacagccgcacgtaatttgaagttgttgagcatttctggacggcgaagatccaaataacggtaacgaagacgggtatcatcactggcttcaatgccgtccttgatttcaaacggagttgtcttagccgtgttcaacactgtcaagctggttacttgcagttcaacagctcctgtcgggatattgtcgttagcttgctcacgctccacaaccgttcctgttacttcgataacaaactcggaacgaagactctccgcttttgccatcacttcagcttcaactgactcagggttaatcaccaattgcataatgccttcacggtcacgcaagtcaatgaaaatcaggccacccaagccacgacggcggccaacccaacctttcaaagtaatttcctgtccgacatgttctttacgaacacgtccagcgtacatagaacgtttcattttcttcctcttttactgattttatacctattcattctaccataaaatagctgattttggggagaaattgccgagaaaaatcgaaaaaccagccctagttgactggtttactatataacatatctaaatgcggaatatcatcctccaaatatacttcagaaactggcttaaagccaagcgattgatagaatttttccaaataggcttgggcaccgattttaatctgactttccttccactcggttgtaatgtaatggatagcttgctccatcattggcctacctaaacctttgccacgatgacttggcttgatgaccacacgtccgatggaaacttcatcataacttagaccagctggcaagattctcaaataagccactaactccccattgtctgttcctaaaagatgaagacaacttggatcttttccatctatttctggatagggacaggcttgttccacgacaaacacatcggtccgaagtgtcaagatagtgtaaagttcatgtaaactaagttgttcaaatgtttttatttcccacttcatacattcctcctagggcagaatgttccctgcacttctgtaaatctcataccattctggtctcgttaaggtaatctggctagcctgggcaatctttgtcaggcgacctggattcatagaacctacaatcgtttgaatctttgctggatgacgcaaaatccaagctacgacaattgtttcatgtgaaacattgtatcgctctgctatttcctcaatagtttgatttaaatgagcatagtcaggatagttggcaaaaatacctcgttgcaaatcaatcaagaaaggagaccaggcttggatagtgatttttttaagctggcaatagtcaattaacccaccatcacgcatagtcgcagcatcatctttcatattgacatgtaatccagcatcaatcaaaggcgtgtgagcaggagatagctgcaattgattaactgcaagcggttgatcgagataggattgtaataactccatttggtaaatgttttggttgctgacgccaaaatgatgaaccttccctgcttttttcaagagataaaaggcttcagctacttcctctgcttccattagagcatccggacgatgtaagacgagaacatctaaatattccgtatccaagcgcttcaaaattccatctacagattccaaaatatactcttttgagaaatcaaaatagcctttacgaataccacattttgattggaggagcatgtcctcacgtttcaatcccgccaattttgccccctgagcaaaacggatttctgattcaccaccaccataaatatccgcatgatcaaaaaagttgattctttgctcaaccacggtttccaataccttggctgtttccttctctctcaaacttgccattcgcatacagcctaaagcaattcgtgaaacttctagacctgtttgtcctaatctttgcatttatcttctcctttgtaaacgcttttcatattccttattataacagaaaaactcagccgaaactgagttttagttaaaaccataaattcttttcgcgattttatagacggcattggaaatttttcgacctgggtaaccgtaaaggttggttaattgcccgagtaacccttttcgaacgattttaaatagagctggattattatcccgaatatagtgccagagttcctgctttttcatcatatgttcagctgttccagcacgattgagaagagcacaggagataatggtcgtaatctccacatgattgagcaaataacttcgtaaatcaggattgtcaatcgcctccaagtctaaattatctaccaaaattcgattgacttttaactgctggtcaatgcgcttaatcatgacggattcattgacagactggtcatttcgcccaataaagtaacgataaaaatctactggcagatagaacatagttttcacagcctgcaaaggagtaaatacgaaaatattatccacatagaaggtatgctctggcagaacgagaccaacctcacgcaataaatctgtcctgtaaatcaaggaatgcatcatcatgtattgccccttggaaaaggcatccacatcttcccagccaaaaatccgattttctggtaaaacatcctgataagacatggattttttacgagattgtccctctttttcgtaaacaaagttggagataaaggcatcaactggcgtattttcatcttccaaagcctgcaaactctctaggatcttcaaataggccctggtatcgacccagtcatctgaatctacaactttaaagtacttccccttggcctcacgtatccctgtattaacagctccgccatggcccttattgtcctgataaatggcacgtacgtttgaaaattgattctctagcccctctgcgatttcctgagtccgatcggtcgacccgtcgttaataatcagaatttcaaccttgtcaccgcccattacaagggaatgaacacagtaatgaaggtaggcttccgaattatagctcggtatggcaatgcttagtaaggtcatctttctctccatttgacacaatttgttactattttatcacattttcaggaaagttgcttttgatattttctttttgcttgataggctctccatagttggcctaagcccttgaaaaaatttccattgacaatggttagaatcccttccaccatcggtaaatcgagcatgtctcctgtcatctttgccattgccctaaatggcatattataaaggaacagcaggttcaagtcaggagtccctttctgctctgcttttttcagtaagccagccaacagtttatgcacgccacgtgccaacccactcttcgcaaattggagtttcaaaactggatcgttcaggctcagttcttgaccaattttccaggtttcttctggaactggacgtccaagcaattgtgcaaaatcctgctctgaaacagcctgcacttgggctgtcagataagtcggaatctgttctgaagcaggaaattggtctacagtgccttctcgggtaatctcgccaactaagcgaatatcctgactacttgcacctacatacaagagataatttccagcctctacttcaaattggcctgtctctttattaaaataacgaaacgtatagtcctcaaaaggaataaaaatctgtttggactcgcctgcttttacatatacttttttaaagccttttaactcctttgcagggcggtaaatctgacgaacttctttgcctacgtacaattggacaatttcagcaccatcaaccagaccagtatttgtaatagtgactctgactcctaattcggtcacatccaattgactgtaagaaaagtctgtgtaggacaatccataaccaaagggatacttgacagtcttgtcaaggcttgtaaagtaacggtagcctacatagagagcttccttatagagggaaaaatcgccttccgctggatagtcatccgaagatggaacatctgcaagattaataggataggtttcgcttagttttcctgatgggttgacacgtcctgtcaaggtatctaaaatggctctggcaccagcttctcctgatagatagccgtgaagaaccgcatctacatccacatcccaattcatatccacaactgagcctgctgataggacaacaacgatttttttacctgtccctaccaaggcattcagtaaggataactggtttttagggagacttatatgatgacgatccaagccctcactttcactcatttcatctagccccatatagtaaagaacaagttccgcttggtttgcaagattgacagccctgtcaactaacaccctgttttctttatctacacgttgatagccttgttcgtaaccaatgacatttaatggataatctgcgatgcaatccactgttttatctaattgtcttgtattgattaaagaagaacctgctccctgatagcgaggattttgggcaaattctccgatgagagctatttttgtctcactagataagggcaagatctgatccttattttttaatagcacaatgctctcagtggcagcctgacgggccaattcatgttgttcagaataatctacagattgtttttcagcatgagccaactctaaaactacatcaatcagctcatccacgcgctcattcaatacttgctcggatagacgaccagactgaacagcgtgaatgatttccttttgaccaacctttttagtacctggcatttccaaatgactaccattttcaacaccgagaacatggtcattggagccaccccaatccgatacgacaaagcctgtaaagccccattcatcacggagaatgtcacgtaagaggtgcttgtcttcattagcgtagacgccgtttattttgttataggcagacatgattgcctttggatttccttcacgcactgcaatctcaaatcctgtcagatatagctctctcagtgtacgctcatctacaatggagtctgaagccatacggcgcaattcctgactgtttacagctaaatgctttggcgttgccgcaacaccttgcgactgcattcctcggatcattgcggccgccagttttcccgcttgatatggatcctctgaataatactcaaagtttcgaccacataagggactgcgcttgatattaagccccggccccaaaatgacattgacacccaagctatttgcttctgcgccaagaccctgtccgacacgttcaaccaggtccacatcccaagaatttgccaaggtagcagctgttgggaaacaagttgcagggacagaggcattcagccctaagtgatcaccttcaccttcttgcttgcgaattccatgtggtccatcagacaaaaagatagatggaattcctttttcagggtaatcctttgtttcccaaacagattttcctgacatgagagctgctttttcttccaatgttaaacgattaataatctcctgatacttcatcatcttttcctcattctatttctttatcactatcatatcagactaaagggacaattaaaacgctttcttcataatctgtatgattttggacataatctgctataaaaaatctccccagaaaatactagggagatcgctcctattacttcttatactcaatgaaaatcaaaatcaggctagctccaacagtctgagaatagactgttggaggtgggagataggacgaacctagttcgtttctatatgagcagatagaactctgtcgctttattattgtcaagcgacaggctggaaacctccactggaactttccactcatcaaatcaagccaacaacggctgagtttgattttcgaagagtattatttcatgattacaaacttcatcattggatagttgacagccacttgaacgaaaatattgacccagttggctgctgtctgtgcccagcccaagctcaagccccatgatgtaaagagttgagtggtgtaaggcggcagcacaatggacaaaattcctgcaacgacaacagtcaagatataccaatggagggttttggatatatcgttttctgctccgaataccaacttcctttgaacaatatagttgacaacctgtgccgctatgtaagccaagaggaaggagagaaagccgttcaatccgccattttctacggaataatgaaagataaaccagtgaaatggctgacttgacaaggctgtaaagaggaaattggttgacaaccaaaggacgcagaagtttgtaatagttgcgatgtttgataagacattaaacttgataaactcccacaaatctgggtgtttggcaatccattctttcatacggtctcctatgcaagacaagggggaaatcccccttgttatgctacttctttttcttcttttttcttacctgtcaacttaacgagtccaagacctgtcaagccgataagggcaatattacttgctaccaatacaacaatccaccattttgtttttggtttatagatgtcaaaggctgcagaatgagcaacggtgtacaagatgttcttacttgcctgacgaagtgctgcaacaccttctttagtacctgttgaggttgctgtcggtgcatcacctactggggttaacataaggtcgccaccattgcggattgcttgatctggactcatgtagtcttgaccgtcaaagtccgtaataaccattcctctgaagccccactcgtcacggagaactgtattcaagaggtcgctattaccccctgcccagagggtaccaatacggttaaaggatgacataatagcagtcgctccgccttctttgacaggaatttcaaaggctttcagatagatttcacgcattgcctgttcatttgaccatgttgcaacaccttctcggttatcttcttggtcattgagagcaaagtgtttggtaaaagtatagacaccattttcaagagcttttgctaccagtgagcttgccattttacctgaaatcagtgggtcttctgaatagtactcgaagttccggcctgagaatggtgagcggtggatgttcactgcaggagcatatagaccaacaataccgtgtgccaatgcctctttagcaaaagcatcacccatttcttccgccaagtcggtattccaagtagaagcaacaacgacttctgagttgtattggatacctttgataccttggaagataccgttgataccagcaggtccgtccaagtcaacaacagctggtttatcgattgatttgactgctcctgttgcataaccaccaaagccaaccaagttgaccatttcatcaacagacatttgagcaactagttgttcccaacgctcatcatcatagtttgcaccaatcaaatcaaccaaacgaagtccattgtcttctgttgtcacagtatcaatcggtgtttcagatgattcgtcaatgcggaagtttgcgttgttaatttctgtagcaatttgctcacttgcttctttgtcttttgtgcgttcggttggcaaagtaccgtcccaatccgcacgggttacatagttgatatcgcccacagcatattcaaaggcgttggttacttcagccttatcagatgaacgttgtttcaagacttctttgctatcaactgtgtaggtttctgaatccaagacatcatgcgcattgttcatgagtttgatttcatagtcacccttgtccaaaacataggctttttctgtcttttcgtcgtaagatgccatatcatcacggtcgaaggaaatggttaattcttcgctcttacctggctcaaggacctcagtcttatcaaatccagccaagacaacgtgtgatttctcaacaccaccttcagtatatggagctgtgtaatagacttgtgcaacttccttaccagccacgtcaccagtattggttactttaacattgacctcaatcttgtcaccattttctttcatgctagtgatttcttggtcaaagttggtatagctcaaaccgtaaccaaatgggtattgaacaactttatcataagctgcttcgtccacttgaccagtcgcattgtcaacaaagcgagtttcgtagtaacgatagcctagatagataccttcttgatagttaacaaatttgtagttaaaggtttgtggttcttttgctccccatggagttttttcataggtgatattagtataagagaagtcacctgtattccagtaggttggattgctttccaagtcgtaggcataggtatcgaccaagcgaccagatgggttgacctcccctgccaagatattagctacaccagtcaagccggttgagccaggaccaccaatccaaagagcagcatcgacgcctgcatcttctaagaagccgagttccatggcatttgaggagttaaccaagacaacaaccttgtcaaagttctctgtcacagtcttcaacatggctttttcaacttcttgaagttcaaggtagtgcttgtccttgtcaccttgttggtattctgccatgttttgtggaaggtccgcaccttcaccaccattacgagaaatgactaccaaggctgtatctgaaaagttcttcgcgtttgttaacagttcctctgagtatttgtcttgagttggctcgtagatattgtaatctccaccattgagggagaaaatatttgtcccttctttttctggaaggttttctgtgtagaagtctgtcaattcgctgttgacttcaaaacctgcattttcaagaccttgttgcagattgatgtttttggactcatctgccgcacctgaaccagatccaccgtaagtaatggctacagaagaaataccaaagacattgaccttggatgatttttcaagtggtagggtcttattcttgttttcaagcaagacagtgccttcttcttgaatggtcgttaccaaggacttagaaacttcttctgcatcagcaattttagcagcatctgcataagacggcgcaaaataggtgtcgatcacattgacaaacatattgacagcatagttagctccaacgataatgatactcaagagagccaagaggccaaagcccaactttttcttcttgctagagagggatttttccttcactacgcgataaatcgcaaatcccaataagccaaggacaactacagcagaacagataaatactgtttttgcaatcccgaccgcatccaatgattgatagctacttggatagctatctgcatagactatttttcctgatagcagagctcctgctaggctcaagagagcccctttccttttccaagtcttcataagacttcctcctaaacatttcggctttcatgtaagccttttctttttcttgaatccactatatcaattaacatactcaatgaaaaccctttcttcataatctgtcatttaaccttcataatttgtaaatttataagaataatcctactcttgctattttatcatttgattttctaaaatatagctaacaatttcattttaattttgatatactgatagaaaataaaaggggtgctttatgaaaatcgcgattgtagaagatcaaaaaattgagcaagatagattgtccaactacatcaaaacctactgcaaaaaagctgggattgcagtggaaatcagctgttttaacgacggtctccatatcactagtgactatcaaaaacaatttgacctgatttacctagatgtcgagatggagattatggacgggatgaccaccgctcaaaaaattcgaaatcttgataaggaagttctattagtatttgtgaccaatcattcccatgtcgctattcagggctactctgttgaggccattgattttcttctcaaaccactgagctcctttgtctttgaggaacattttaaaaaaattcttagaaaattacccgatagccaagagaagcaaagtttgtatataaaaagcaagcagtccaccgtaaaactctatcaagaagatattgtttacctagaaagtcaaggacatcaggttcacatctacacagttgacagtggcctaaccattacccataatagtctcaaaaatctcgaagccatgttaaacagtaaattgtttgtacgagcccactcggcctatatcatcaatttgtcccatgttcaaaaagtggaaggtagccttgtttacgtcacaaatacagccttgccgattagccgcccaaggaaaaaagaatttatgacagctctaaccaacttcatcggagatagcctactatgatcaatttccctgatattccacgtttctatactgcactaacagaaagcttggcctgcctactggtatgttcctcacttgttttgtctgaaaaatggtcacgcaaacaggtacgtatcctcctgatttttctcatacaaatcttacttcaactagcggctggcaaactccccttgctcctttggactgtaggaatgggcaccaatatcgcttggatgtttgtttccgttcgatttcttggagttatccacaagaggactagtctctatttgacagcaaaagcctttattattgccgaattagtagcctccattacttggcatctctactgtttgacgatttatcaacaacctgtggataacttgtggacacaggggttatttctgttgataacttctctactttcctattggctcatctatcttcaagatcaaaaagttcgcttagaagaattggataaattcattgagcagcgagatgtgacggtagccgtctttacaactttatctatctttgttctcagtaatattggtttcatcctctcaggcacgcgccaatttcaagattcgaccagcatcttcattctccggacaaccgtcaatctctctggtcttctactcctattcacccaagaatctcaacaatacgatcgctatttacggcaggaattgacttctatcaataatatctttcaacttcaatacaagcaataccaagcctatcgtgaaaacagtgagattcttgaccgtaaggtccatgatttaaagcatcaactggccatcattcagcaagaatcggataaaaccaaaaaggagcaatacctagaggaaatgagcgaggtgatccagacacttgatgccaagattgaaacaggaaatcccgttctagataccattctcagccagaaaaattattactgtttgcaaaatggaatcaactttacctgtattgttcagggagaacccctccattttatggatgtaatggatatttcagctctgtttggaaatgccattgacaatgccatcgaggctgtggaaaaaatagacaatcctgaacaaagcttgattactttaaaggttgccagccatcagcaatttctcatcatccgattagacaactacgatacttcttcgcttgacttatccacaggacagctcccagaaacatcaaaaacaaataaggactaccacggattcggtcttaagagtatggagtatgttgccaataaatacggtggcagtctcacacttagcaaggaagataattgggttcaactaaagatcattctccctttacaagtatagaaaaatcccgcttgaaggcgggattttctttctattcatcatttagaaaccgttacttgctccacatctcgactttgactccgttttataatcacatcaagataatcagccaagaaacttctcggtgatgctgcttgcaaggtctgataagcctggcttggaaataccttctcatctagccaagtctgatctagtttttctcctgaaaaataagcacggttggccggcatgataaattgtgaaatagcgtctgccgtctcgccgtcataccaacgctcatcgttcaacacattgtggaccatgatgtcactggtattgtcaaagacagtttgtaagtaggtaacgtgatcctgcaaatttggatcactaggttggtgcttttctgcccacgaagccatatcaagttgagttttttgatagtgaatgcttgtatcatcaaggctcaattgaccgataatagctggataaatagaaaatgctccattgaccacttcagtatagttaacttgtcccaagtcttccttaacaatattctgagaatgagtatggcctgaaaaaccaaaatgaatcccatactgatcaaacaaagccttcaaatcggcagcattatccaaagtatagccttttgagagcatggcatgctgttgcaagacattgtgatggacaacaggtaacaggctcactccagcttccttggctgcctgaagctgaacttctatccattctagggtctcttttttgatacatccattggttggaggagctccttttccgtagccgtcagagtagatgttgctgtctatcatcagaaaccaagcattggaaaatggtttggccaggtagctcaatgaggctttgtcacgactgctagcttgttgataaccgtgattgacaaatagctctgcaaattgctgagcagtgacctgatccgtcactatctgctggtctcccttaaaggctctagcccatccactggcaatatcatggttgccaggaatcaccaaaacctccgttcctttttcttcaatccgggtaaaatattgcgccaactcaaccatgctctgtttttcaccgtttagagtcaaatccccactgactagtaataaggacggttgctcacgctcaacctgctcaaccaaagcctccatccgctcttttccataacgtaaatccttaccagcagctgttttttctatataggaaaaagcctctccatcatcaaataaatcctgtgacaaataatgcaaatcagtgataatccagattttatcctggtctcttaactcagcctcggcataggattgctgacgctggccagtaatagccgaccaagtcaaaactataactgcaatagctcctaataataatactattttcttcttcataccttaaaagtatatcatcttagagatagagggacaagaaaaagaagctcgaccttctttctgccgagcctcttatgtctacaatttatttcttagcaaatccagctgcttgttcaccagcctgacgaccaaatacgatgatgtctgctgctgcattaccaccaatacggttttgaccatgaacaccaccagttacttcaccagcagcataaagaccagaaattgctgaaccgtctgttttcaatacttcagtattggtattgattttcacaccacccattgtatggtgaacaccaggtgcaactttaatggcatggtaagaaccagtattcaaagcatggtccatacctgatgtacgaccaaatgccgcatcatttttgtctgccacagccttgttccaagtatcaagtgttgtttgaagagcatccgcaggtacaccaatttctttagccaaatctgcaagagtagcacccgtttttacaagacctttttcttcatattgagcaatagccttcacacgatctttcaaggcatcatcaaagataacataagcatagtttggatccaaactattgatagccgcagaaactttatcacgagtttccaattcgttaacaaaacgctcaccttttgagttgacaaggatagcaccttcgccacgaactgcttctgtaatcaagtaagaagtttcttgctcaacacttgggtgaatttggatttgttccatatcaacagttgctgcaccttctgattcagcaagcgcaataccgtcacctgttgatccttcttggttagttgtaacataacctttcaatgctgggtttaatttagcaaccatttccaaatcagcaccgaaaccaccagtcgccaatacaactgctttagctgagattttcttagtttcaccagcaatcttcacttcaacacctgtcacagctccatccttgtcttggagttttgtaacatctgcattgacaaaaattggtacttcacgttcaacaagattgtggtaaagaccatttaccaagtagccaccgacagctgaaccatctgctggacggtgggtacgtttctcgctcataccaccagttgtagttaggttgctaagagtgatccccattccatccaaccagtcaattgcactagcagagttatctacaagataacgaagcaattcaggatcgtttgtccctttaccacctttaagcgtttcttcgtagaatttatcatttgtatcagcaataccttccgcttcttggaatttagtctgtgaagcattcataccagctgatgatttagccgtattaccaccgataacaggcattttctccaagagagcaacactagcaccagcgtctttagctgagatagctgctgacatacctgcaccacctgaaccaacaacgataacatcgtagctatctttcaactcagatggatctgtataaactttctcagatgcacctgaaacagcttcttctgatgaagaagaagtcgtagatgatgaagatgtagctgtcttttcagacttacctccacacgccactaaaaacaaaacagcaagtagactcattaataagcctaaccaagctttctttttcatataaacctccaatttttatctggtattagtattatacaagattgtgaaatgtttttcaatttgttttgaaatattttcacaaacatgaacaaaaaaatgtatgatatccgcttcatacattcttaaaactatttactgcccttgaagagctaaaaaattctctatttcggatagcgttgcttggctccctttacggagtattccagataatttacctgatttatagtaggttaagctaggaaccgtagcaagaccttgactctgtcgaaattgttgtatttttccattcggatccgactcgctatctaaatagtagatcgtcgcatgtgattgctctactgcctctgttaatttcggaacaaaatcacgacaataagggcatgtctcacgacctatgtataatataaattcttcctcgtcttggaccttttgctccacttcgtctatcgaaatagcctggtaactctttacagccttcacatagtctgattcatttggcgtagccgctgattgagatagaaagaaggccccacctacgaccaaaatagctaatagcactagcaaaaaatacttacgccacataatccctcctcaaatacagacaaaaagcccttgtaaatagggcttttaaaatatcgatacaaatcttagagcattttgttgtagaattctacgacaagagcttcgttgatttctgggttgatttcgtcgcgttctggcaagcgagtcaatgaaccttcaagcttttcagcatcgaatgatacgaaagctggacgtccaagagttgcttcaacagcttcaaggatagctggaactttgattgacttctcacgaactgagatcacttgaccaacttcaacacggtatgaagggatgtcaacgcgtttgccgtcaacaaggatatgaccgtggtttacgaattgacgtgcttgacgacgagtagttgccaaaccaagacggtaaacaacgttgtccaaacgacgctccaaaagaagcatgaagttgaaaccaagagtaccttgtttgattttagtagcttgtacgaacaagttacggaattgtttttcacccaaaccgtaagagaaacgcaatttttgtttctcagccaattgcaaaccgtattctgacaatttagaacggttgtttggtccgtgttgacctggtacgtagttacgacgtgccaattctttacctgtacctgtcaatgacaagccaagacgacgagcttgtttccaagatggtcctgtataacgtgacataagttatgtcctcctaaaataaaaatttccgtcatttcgtttctcttttattacgtcgttaagtcggcttggcatacctcagtatagcctgcacctccttgcctagtactaaaaggaaacaaaaagacttatctgtaggaaataacgttttaagcaaacctgattcgtgcaggaggccttcatcgaaacagcaacgattactcttcttgctgaccttctgttgacgagcttcattttgccctgctgttatttcacacaaagattagtatagcacaaaaaaaaggctctgtaaagccttatatagcgattaatccaaataatgaatcaaaatcttttcagtcaaaatgtctgagtaagtataagattccacaaaggtattgtttggatcttcaaattcaacgatgaagagagactgataaacctctacaatacgcccctgcttattcttctcacgcttacgaccattttcaagggtcaactcgacaatctgtccctcatggtccttaatatcttgtttgatttgcttcatcttagcaacatctgtaaatgcatcactcattctctatccatcctccctcttggaaatacttgcaaatttattgtattctttttggaacatgagttccacggtaccacgcgcaccggaacggtttttctcgatgataacttcaaccgtattattgggaataccaccgtcttcttgctctcctcgttcataataatcatcacgatacaagaaggcaacgatatccgcatcctgctcaatagaccctgactcacggatatcagacaagacaggacgtttatcttgacgttgctccacaccacgagacaactggcttagagcaataactggaacttttaattccttggctagaattttcaattgtcgagaaatctctgaaacttcttgttgacggttttctcgaccggttcctgtaatcaattggagatagtcaatcaaaatcaaacctaaattccctgtctcctgcgccaatttacgagaacgcgagcgaatttcggtaatcttgatacctggagtatcatcaatatagatacttgctcgagccaaattagcttgagccaccatatacttgttccattcctcttgcgttaggtgacccgtacggatagccctcgaattgataactccctcagaagcgagcatacggtcaaccaagctttctgcacccatctccaaagagaagatagcaactgtcaaacccagttttgtaccgatattttgagcaatattgagggcaaaagccgtcttaccaaccgcgggacgagccgcaagaataatcaactcttcctcatgcagacccgttgtcatggcatcaagagcaggatagccagttgcaatccctgtaatatccgacgtctgcttagcacgagtttcaaggttgtcaaagttgatattcaagacatcatcaatccgcttgaaaccacttcgactggctccctcactgacatcaatcaaagctttttcagcattggcaataatgtcatctgaaccatccgtaccctcataagcctgattaactgcatccgtcaaacgggcaatcagtttacggagattagacttttcagcaacaatcttggcatagaattccgcattggctgccgtcggtacggaactaatgatttcagccaaataggccaaaccaccgatattttccaaatcaccatggttcactaaatagttacgcatggtagtcgcatcaattgcctcatttctatcagaaagagcaatcatagctttaaaaattagcttatgagcatgtttgaaaaaatcttcagcttcgatgtattcacgaacgaagaccagcttgccttcatcaaggaaaatagctcctaataccgattgttcagctagaatatcctgcggttgcacccgcaattcatccaactctgccaagatctcacctcctcactggctagataaataattaagcttccttaatactcaaattaatgatgcctgttacatcttgatagattttaactggtacatcaatgagaccaatcgcacgaattgggtgatccagctgaatatggcgtttatcaatcttgatgccaaattgcttgtccaattcttcagcaattttcttgctggtaatagaaccaaaggtacgaccatctggaccaactttttcgacaaatttcactaaagtagcttcctcagccaacttagccttgatagcctctgcttctgcaatcatctctgcatgagccttttccttagatttttcctgaccacgaagggcgctgattgcttggtttgttgcttccttagccaaatttttcttgatcaagaaattttgggcgtaacctgttggaacttccttaatctcaccctttttaccttgacctttaacatctgctaaaaagattactttcatatctgttctcctaatttccatttatttcttcgcggattttatccgtcaacttttcacatacttctgcgattgtctggtcatatacctgagcggcagctaggttaaagtggccacctccacccatttcttccatgatgcgttgaacattgattttattatgactccttgcagaaatagatacataccctttgatatttcttgttacaacgaataccgcctcaattcctgccatgtccaatattgtattggcagccttactcggaataatattatcgtattctttagtatcatctgcacacgcaataacaacattggactcaattctctgcccacttaaaatcagttcattgatttgacgatattcctcaaaatctgtcgcagcaatctgctggatttccaagctatcgctaccacgagtccgcaagtaactagccacatcaaaagtacgactagtcacacgagaggtgaaattttttgtatcaagcataatcccagccatcaataaactagattgaatgcgattaagcttatggtgtttgtcattctggaactgaattaattccgttactaactcactcgcagaactagcaccactctctatataagtcaaaactgcattatttgggaaatctgtatcgcgacgatgatgatcaaccaccacaacctgggtaaatttttcatagaaatccttatccaaagtcaagccaatctttgaatgatctaccatgattaacaacgactggaaagtgaccatcttcatggcttcctcaaccgttaacaaattagaacaattttcatcactcaacttcttgatagcacgtgcaatatctggtgccatttcatctggattatacaccgtataagcattgttcataatattttgagcaaagtactgcatgccgaccgcggatccaagcgcgtccatatctaaattacgatgtcccaccacaaaaacagcatcaaccgatttgagtttatctgatacagcagtcatcatagcacgagtccgcgtacgtgttcgtttaacggaagaagccgagccaccgccaaagaaaagtggctgtttactctcatcattttccttgaccacaacctggtctccaccacgaacctcagccatattgagattttggagcgcaacctgtccgatttggtgatgattttcattaccatacgccaatcccatactcaaagtcaaacctaaatctaactttttagcctcctcgcggaacttatcaataactgaaaacttattctctatcaatttttccaacacagcataatctgtaaagaaatagaatcgatccattgtgccgcgtcggtagtagataccgtaatcatggcaaaattctgaaacaaattgagccaagaaggaattgacttggctaatttgagaatcagttacagcatcctcaagctcgtcatagttatcaactgaaataatccctataacaggacggcttccgatcaaactatttgtcgctgaatactctgtcgacgcatcaaaaaagtaaaataacccttgatcaaaatcaacgttaacagcgtatctcttgcctgaaaagtttgcataaattcgctcctcatccagaccaacgtcaataatttcacgtagttttttttgatcaaactcaccattttcttgagcaaaaatcagctcagcaaagggattaaaccattctacctgattactatctggtcgaactttgataactcccactggcattttatccaagagcatcatcaaaccagaattggcctgattattgagatattcaatctgttctagctcactaaattcataagaatgtttttgataaataaacagcgcaatcaacaccaataggctgatgagtagcgcaaaaactgtactggcaccaattggaaaaaatcggtggacaagagccaccaacccaaataaaatgacacatatcatgacaaagtgaattgtcgaaaatcgaaatcttttcatcactaacctctgcctgccattctaccataaattcagtaaaaaagctacttttcacatgattttaaagtagttgacatatagctgacatacagcgaaaagaacagccttagtgactgtcctttgatttatttttagaaatggaacgactgcgtccttccaagtagaccatgagaatggatatatccgctggattgacaccggaaatccgactagcctggccaatggtttctggtgaaatcagcttgaatttttggcgagcctcggtcgcaatggagtcaatatcatcccagtcaatgtcggctggaatgcgtttttcttccatacgtttcatcttctccacctgatctaaggccttagcaatgtagccctcgtacttgacttctgtttcaatcaattcaatggtcttggcgtccaaatcctctgccgcaggaccgataaaggctaccgcatctgcgtaagtcacatctggacgacgcatgaattccttggcagtcagagcgtctgtcaagggcttgaagcccatggctacgactttttcgttggtttccttgattggcttgagtttgatagactccaaacgcttcatttcattgtcaaattggtttttgtgaatctggaagacctgccagcgttcatcatctaccaagccaacctgacgaccaatctccgtcagtcgcatatcagcattgtcatgacgcagaatcaagcggtattctgcccgactggtcaagaggcggtaaggctccaccgttcccttggttaccaggtcatcaatcataacaccaatgtagccgtcgcttcgtttcaaaatcagctcaggcttgccctgcaccttgagggctgcattgataccagcgacaattccctgacctgctgcttcttcataacctgatgttccgttggtctgacctgctgtaaagagccctgaaatcttcttggtttcaagcgtcgcccgcaactggtgcggcataaccatatcgtactcgatagcatagcccgtccgcatcatctgggcattttccaagcctttaatagagtggatcaagtcctgctgcacatcttctggcagactggttgacagcccttgaacatagatttcgtctgtattgcgaccttctggctctaggaaaagctggtggcgttccttatccgcaaaacggacaatcttgtcctcgattgacggacaataacggggcccaatccccttgacaattcctgaaaacataggtgctcgatgaagattgctgttgataatctcgtggctggtggcgttggtataggtcaaccagcaaggaatttgatccagcaaatagtcctcgtccttggacaagaatgaaaagtggtttggcttttcatcgcctggttgaatctccgtgtcttcgtagttaatggtacgagcattgacacgcggtggcgttcctgtcttgaaccgacctatctcaagtccaagttctttcaggttatccgccagcgtgatagaggcaaggctattgttaggccctgacgaatacttgaggtcaccgatgataatctcaccacgcaaggctgtacccgttgtcaccacaactgccttggctgagaatttctggttggtagccgtgcggacaccgataaccttgccatcctccaccaaaatctcatcaatcatggtttgacgcagggtcagattttcctgacgctccaccgtccgcttcatctctgatgcatactctgccttatctgcctgagcccgcaaggcacgaacagctggccccttgcccatattgagcattttcatctgaatgtaggtcttgtcaatgttgcggcccatttcgccacccagggcatcgatttctcttaccacaatccccttggcagagccaccaatggagggattacaaggcataaaggccaccatatccaagttaatggtcgcaagcagggtcttacagcccatccgactggctgccaatcccgcttctacacccgcatgccccgcaccaatcacgatgacatcatagttttctgcaaatgtgtgtgtcatgttgttctctccttcatgttcatgatatgtttaacttgtccactccagtttggtaattcctgtgtcagaaaagctggtacgacatctaagttgacaaggttgtcaagtgcaatccattcacacggttgtttcaacttcccttcaatcatctccttaggcatttctccaataggctcaacgataaaatgaaactcgatattgtgaaaatctataccttcatgtgtaaactgattttcaacgacaaaaactaattgattgacacgactgtcaatccctaattcttctttgacttcccgaacagccgcatccgctgctacctcattgacctcaaccgcaccaccaatcgtataataacggcccttagcgtccttcgtgagaaatattttcccatcttttataatcaatgcagtggcacggacaccgaagatttgattgtcaattctggtcctaaaatccatttatccttctcttttctaaaatttcgtccagatatggaactaagtttttcttatttttatcgctaggggctaaccatagaaaatctgtatgctcttctgggtcaagaagaatggttttcggttgttcaggaagtgttacttcataaaccagccttgtaaacaccgtctgtttttcttcatcaaactgactatcttcatggataatggtcagattttccttttctatcgaaatacctgtttcctcaaaacactctctcactgcagcatcacggggcaactcattctcctcgacacgaccgcctggaatatcccaatgcagcggaaatacattcggctctccacgcttaatctgcgaacgctgaatcatcaagtgactgtctgcaacagtcagcaagacatgggcaatcaatttaacaggcatggtttcctccgctactttagttgtctttgttcataaaatgctttagttgtccgtcccatttggctagctcggtcttaagaaaggctggattgagatccaatttctctaagtccacaaaagcaatccattcacactggcgaatggaatttccttcttccagataggtgactggctcggacagtggggtaacaagataaagaaattcaatctgatgataggatttctcctgcaaggtgaactgattttcaacgatgaaagctagtggtccaacctccacatcaattccgatttcttctttcatttcccgttgcacagcctcttcggttgtttcaccaagctgaatagctccacccaaagtgtagtatttcccttcaggcgacttaacgagatataacttctcatcttgtaccaccaagcccgtcgcacggacaccgaaaatttggttgtcaactctggttctgaaatccatcttctctccccaatcgcaaaaaatagccaaaactctcgaaaactgcaggacaaaaaagcctacaattcccatgagctttgaccatcatgataattgttacgcttattttagcaaaagatttgtagaatttcaaatctggtgttacgttaacgtttcaatatattctaagccccaagcctcaacagcatccagcaccgaacgaaatttttcgcccatttcagtcaagctatactctacacgaggggggacttctgcatagaccgtgcgactaataatgcgatcctcctccaattgtctaaggtgccttgttaacatggtttgagtaatacctggaattagtcgctgtaattcattgaagcgtttcgttcctgtactgagttggtagataatcaccaatccccacttaccagtcaagactttttgcgttgttgcaaaaggacaaataccatattcactaactttgttcaaaaaaattctcctttatttatcacaatagtatcacttttgataccaacaaatacaaaagtacctacttgtataattgactacttccactataattgtactatatcaaaaaaattggaggacatcaaatgtcaacaaacttagaaatttttaatgcctataacaatgctctcatcgctggtgattttgcagctctttttgaaacaatggcagacgacattatctggcatcaacccggaaatcattcaacatctggtgctaaaattggtaaggaagtactcggagcacatctagcaactttcgccgaaaaaacaaatggaactttcaaagtagtgacaaactgggtatccgataatgatactcttgttgccgctaacgtaacattcctcggtactcgcacagacggtgaagaactaaacatgaatggtatcgatcttttccgtatggaagatggcaaaatcaaggaagtttggctcttctcagccgaccaaaaagccgaagatgctttctggggataagataaatagcttagcacgagagtgctaagctattatttttgattaaatatactgacaagcctctccgtctttataggccatgtcaatcatgccgccaccgaggcattcctgtccgtcatagaaaacaacggcttgtcctggtgtgatagcccgttgtggctctgcaaagatgacttctgccttgtcaccttttaccttgacagtcacttgactgtctggttgacggtagcggaacttagctgtacactcaagtgtgaattcttcaggcatatcacgtgtaaagtgaacttgactagcctgtaaagaagttgacatcaaggactcatgatagaagccttgaccgacatagaggatattttttgacaggtcttttccgacaacaaaccaaggctcattgtcccctccgatttgtcctccgataccaagcccgccccgctgaccgattgtatagtacatgaggcctgtatgctctcccatgtcacgaccgtcaacggtcatcatccgaccgggctgggctggcaaatactgccctaaaaattctttgaagttcttttcaccgataaagcagatgcctgtcgagtctttctttttagcggtcgccaagcctgctcgctctgctatttccctcacctgaggcttttgtaaatggccgagcggaaacatggttttctgcagctgttcctgtgagagttggctaaggaaataggtctggtccttaccattatctgccccacgcagcatatgaacggtgccgtcctcgtcgcgggtaacctgagcgtagtgccctgtcgccacatagtccgcacccaagttcatagcgtaatccaagaaagccttgaacttgatttccttgttacacatgacatctggattgggcgtgcgaccagcccgatactctgctaaaaagtactcaaatacgcggtcccagtactctttttcaaagttgacagagtagtaaggaatgccgatttgatctgccactgcagccacatccttgtaatcttctgttgctgtacagaagccattttcatccgtgtcgtcccagtttttcatgaagatgccgatcacatcgtagccctgctctttgagcaagagagccgtaaccgatgaatccacaccgccactcataccgacaacaacacgggttttagaattgtcaattgacataatcttctcccatcttttcgtagaaataacgatttgaaggtcgtattccaaaatttgattatccaaaaacgattgacgattttgaacaacttgtattataccatacaaaaagggtaagcgatagaattttaacataagaaaacacattcatctaggcatattctctaactggaaaatttgatataatagtaccaagaaaaacgtgaggattactatgacaaacttaaaatttcagtcggtctttgatattattggacctgttatgattggtccatcttctagtcacacagctggggcggtccgaattgggaaaattgtgtcttccatcttcggcgatgagccgacagaggtggaatttcaactctataattcctttgccaagacctatcgtggtcacggtacggatgtagccttggtagcaggtattctgggcatggatacggatgatccccgcattcctgactctcttgatattgcaagagaacgaggcattaaggtttactggcgtgtcaacaaggacagcaataccccacatcccaataccaccagaatcatcataaaaaacgataaaaaatccatctcagccacaggcgtttccatcggtgggggaaacattcaagtaacagagctcaacggcttctctgtcaatctaaatatgaatacgccaactattattattgttcaccaagatgtccctggtatgattgcgaaagtgaccgatgttctttctaagtatgacatcaatatcgcccaaatgaacgtgacacgtgaaaaagctggcgaaaaagccattatgattatcgaagtggatgctcgccaatgtgaaaattctattgcagaaattgaaaaaattccacacctgcacaatgtaaccttcttcaactagaaagagaaagacatgttttatactatcgaagaattagttcagcaagcagacaacttttctggtaatgtagctgaactcatgatcgcgactgaaattgagttgaccggtcgtagccgcgaagaaatattgacaattatgtcaagaaacttgacagttatgaaagcctccatcgtagatggacttactgaaagcaaatccgtatctggtttaacaggaggcgatgctgccaagttagatgcctatatgaaatctggtaaaaccttgtcagattccgctgtcctatccgccgcaagaaatgccatggccgttaatgaattgaatgccaaaatgggcttagtctgtgccactccgacagcaggatctgcaggctgtctaccagctgtgctaggagttgctattgaaaagctcaatttgacagaagaacagcaacttgacttcctatttacagctggagcctttggactagttatcgccaacaacgcctccatctcaggtgcagaaggaggctgtcaggcagaagtcggatctgcctctgctatgtctgccgcagccctgacactggcagcaggtggaactccctaccaagccagccaagccatctgctttgtcataaaaaatatgctgggtctgatttgcgatcccgtcgctggtctggtagaagtcccttgtgtcagacgtaatgcaatgggagcaagctacgccatggtagctgccgatatggcactggcaggaattgaatcaaaaatccctgttgatgaagtcatcaacgctatgtaccaagtgggatctgccctaccaaccgccttccgtgaaactgccgaaggaggccttgcagctacaccgacgggtcgtcgccttgctcaagaaatttttggagaagattgacaataatgtaaaccaaaaaggaccctaacggtcctttttcttattatggcttcgggctagttttctcatagagaaaaacaagaaaactactacctatgctggtggctagcaaggctttgagcttctatttttttcctgttataatctaatttgtcaagttaaataaaggaggagtaaactagtccagtggactagtttagcatggttaaaaccgttacagtttatcacataccaaatgtatgtcactcctaagtaccgcagaaaatccatttactaaaaaattagacgggacttaattgatattttccatcacctatgtccatacagcgtggaaatcaaaagttttgggctagaggctactattcagtaccgttggactgaacgaaaaagcagttgtgaaatacattcgtgagacagaaaaagtctagcatcgtgctagacctcttctaatttatcttagtaccaaccatttgccaaccagaaagccttggctgcagaccatgaaccatagcgactagcaacataagcatctgctacacgctcttggttttctggtgagtaatcaccattcaagtaagtatttgtcaactggtaacgaccaatgtagataccgttacgggcatcatagctaccgcttgattccttcattgcaatccattcttttgctgctgcatcttcagcactcaaatttgaagaataggtgctagtcgttactgttgcggtagaagttgatgttgattgagtttgttcaactgaactctctactgccttcactgtcacatcacccaattcgataacttgaccgacatggataaaatctaagttggtaatcttattctgctctgctaatttttcaacagtagtattgtatgtttcagcaatttcagacagggtatcaccagactttacagtataggtttctgcactgactacacccgcagttaaaagggagattcccgctaccaaaccagcaatagttgtttttaagtttttctttaatgtaatgttcataatagtcacattcctttctgtcatgtgtctatcataccctctaactattacttagactttgtgaaattgttacaaatattacagacaaattgagattagacaataaaaacgctatttctagcgttttttacttattttttcaatataaataagagtccggctaaagctaacataactaaaattgctaacgtatctgctaacttccattccaaaatccggtacttggttctcccatcgccgccttgatacccacgcgcctccatcgccgttgcaagagcatctgccctcttaaaacttgatgcgaataacggaatcaaaataggaataactgactttaccttctgaataagatttccctcattaaagtccactccacgagctctctgagcattcataatccgagtggtatcatccatcaaggtcggtacaaaacgcaagctcatggacaacatcaaaccaatttcatgcacaggaactttaaatttcttcaaaggtgcaagccccgactcaataccatcagccaagctaaggggtgtcgtcgtcaaggtcaatagggttgagaagaaaataatcaaaacaaagcgaacaaaaataatcgccgcctgttgcaacccttctacagataatttaaaaatccaaaactcccatagaatggtcgctccaggtgtaaagaaaacctgaaagaaagttgtaaatagaataattcctatcatcggtttcaaaccattaataaaaaatgataagcgaatacgtgataaaacaaccattcctaaaacaaatgctatcaacaaggcattggtgaccaaattattggcccaaaaaatcatcaatagaaatccaaacattgctaaaagcttacttcttggatccaagcgatgaataattgaatccccaggaatatagcgacctaaaattaatttatccatgtgtcaccatccccgtaaattcttcaattgtaataggaagacgttcaaatacaaagcctcttctctccaaattagctgcaaacttagtaatcttaggcactcccaactgaatactctctaaaaaatctacctcttgaaaaatatcgactggtttaccagaacggaccagctttcccttttccataatgtaaacaaaatcagcatagttagccacatcgtccatcaaatgagttaccaaaacgattgtcatgcctgattcatgaagctttttgaaaatatccatcaattcctgacgacccgcaggatccaatccagccgttggttcatccaaaactaagatacttggttccattgccagaatcccagcaatagctacccgacgcatttgaccaccagatagttcaaaaggactacgctcaaacaagctttcatcaattccaaccaaggccaacttttcacgcgcaatcgtttcagcctcttcctgagaaactccgaaattttgtggaccaaaagcaacgtcttttaagaccgtttcatcaaacacttgactttcaggaaattggaacaccaaccccactttcttcctgacttgcttaatatccttattttcagacgtcgctgtaatcacaacatcatcaataactactcttccttctgttggtacatttaatccattcaagagttgtaaaatcgttgatttgcccgaacccgtatgcccaataagggccgtgtaagagccatcaacaatctccaaatccacaccaaaaagcgcacgcccctcaaaaggagtgccagcttgataggtatagcttacttcttggagatcaattcccataaagtttcctctaattcttcctctgtaaaatagcggagcggtaaatcaagtccagtctggcgcaaagatgaagccagttctgtcgtaaacggtctatccaagtctaaatctaccaaatcttctcgcataaatagttcatttggagtgctaattgattcaacctgtccatttttcatcacgataactcgatcactcaatgcaacctcatccaaatcatgtgttatagagataaccgtcataccatgacgctccttaatttcacggacaatcttaatcaagtcgagacgaccttctggatccaacatagacgtagcctcatccaaaataataatttttggacgcaaggcaaccactccagcaatcgccaccctctgcttctgaccaccagataaacgagcaggctcacgtgttttgaaatcagtcattccaactaattccaaagcttcgtcaactcgactacgcatctcctccaaagggattccctgattctctaaaccaaatgcaacatcatcttcaactgtagcgcctacaaattggttatctggattttgaaaaaccataccaatcaagcgtcgcttatcccatacattatcaatggttaaggcatcaccgtcaatataaatatcacctgattcagcttccaacaaaccatcaatcaaacgaactgttgttgatttacccgaaccattatgaccaataatagatagccactctccctgtttcacgtgaaacgaaacatcatttagagtatattgctcatcctcttggttgtatttatattttaaattttttacttcaataatattcatcatttaaatgtatctttaaacaagaaggacgcacccttgaaataatcatagccagaatatagggtgaagaaaagtgcaatatagagtgttatttgccccacgacgttccagtgtaagagcaggaaaataactgcaaacatctgtgaaaatgttttgatttttcctggcatagccgcagctagaactgttcctccattttccaccaagagtagacgaagacctgtcactgccaattcacgacaaataataattgcaactacccaagctggagcaaagccaagctctacaagcatgataaatgctgtcatcaccaaaatcttatctgccatcggatccgcaaattttccaaagtttgttacaacctgccatttacgagccaagtagccgtctagataatccgtaatactagctaatgcaaaaataagtgctgctaagacatgactaattgttgaattccaaacggtcagtaacaagataaaaattggaattaccaaaatcctacctatcgtcaatgcattgggaatattttcttttttcatataaaacctttattgttcaaaatttattgtaattgagcctgtatctgctgtcagagctgatagttctagcttttgaccacctacacttacctcaacccctttaacaacaccaagaataagtgtagtagaagtcactccttcttcaatagtagtagttactgttggattatcaggtgttagtgtaacgcccccctctaacaaggtgtcagaaaggctgatccaactcgttgtattttttgctgttacagttacttctactggataagtcactgttttaagggtcgcaacaatgttagaacctgatcctgaaatagtcacattttctgtagcggaactacttgaactcgttgaatttgactgcgcctgctcagtagaactcgtctctgtgccactacttgcttcagatacagattgctcaactatactatatgacgttgtagtaggcgtaatagatgctctatttttgagcctgctatgaacaatataaatcacaaaaataataatcaaccccgtcgcaagtaataagtaaatcaacggaagataagagttctttttacgtttacgaaccttatagcttcttttcaattctgaagagcgtagttcttcttctccatcttcataatatttcactaaactattggtctcgtaagcatccagtagaacatctgcatctaattccaaagcctcagcgtatgcttttaaaatagactgaacaacatctgagtttgcaataaaatcaaaatcattgtactcaagtgcctgcaaatatttagcttggatttttgttatccgttgcaagtcaacaaatgtccaaccccgtccttctctggctgttctaagtacttcccctatactcttttgtctcataataccctctctctatcgctcatcatgtacagtatactattctaacaaaattccaaggaaatttcgacgggttgcgcccacttattttggaaaaatcgtgaaatctgtcatatcacagtgatcaataaagcgacgacctgcctctctgatgtcatctaactgaagactttgtatcatttgaggtatatcaaaaacattttcatattctgaatactgagaaacaaagtgactagctgtaaactcaagagaatttaagctacgaataaaatctccatacatctcgtttttcaacaattgtaaatgatcctctgtcacatctgcatcatcctcaaatttcctaagtgctttcatcagtatactagaaagcgtaatgggttcttgagtatctcccgagataatcaaatagtggtattcaggtgtaacctctaattggaactggaaagaagaatcaatttttccctgctcgtataactgttgatagcgttttgaagtccaaccaaacaacatggcaaataaaaattgtaaactaagccgatatttctgaatagtctccttatcaacctcgtcatttccccgtaaaccaacagccaattttggggtagatacttcaaattgttctgagagatgttcctgtatcggcaacttttggatacctgccaattcaaacgactgagctggattatccatctgagctacttgataacttgaaatttgtttccaaactgcctctaaatcaaaattaccaataacgaataaattcatgttacttggatgataaaacacatcaaaattctcatgtaaatcatccgcagtaattgcagcaattgattcaactgtccctgctatatcataggccaaaggactttctggataaagcgatgatagaattcccgtaaacaagcgataatctgcatcatcttgatacatctcgatttcttgttcaataatcccctgttctctttctacattgtcttctgtaaaatacggttctcgaacaaaagattgtaaaagtgatagagactccaatactttctgagtcgttgaaaataagtaactagtctgtctaaaactggtataagcatttgcgcttgctcccaatttagcaaactcattcataatatcctcttcattctcagtttcaaacagcttatgttctaaaaaatgtgcaatccctgcaggataaacaacactattaccattagccaatgtaaatcgagtatgaatacccccaaaatttgtcgttagaattccatatgtctcatggaaatctactttaggaagcaaaataactgtcaacccattgtcaactttcccataaaagacagattctttcatgtaaggatacttcttctcaactaacttcattcttctgtcccctccataaagtaaacagcctgtaaattaatcatctgtcctacttgaatgacatcgtctattgataccgatttgatagcctcaatccaatctaaccaacttaaatttctatttcctaaggtaacttgattatatacttgttctatcaaattattctgcctatcttgagccaaggttgctgaatgaatcaacatgttttttgtcaactctaattcttcttctgtaaacttaccacattttaaatcaagtagttgtttactaattaacttcattaccctgagtctattttcacggctaattccagcatagacctttagcattcctgaaaaaatagagacctgactaccaattgtataggccaaactttctttctcacgaacattcataaataacttcgaatgggagaaagcacccagtagaccattaaataccatcaaagccggatagtttacatcgttgtaaaccacctgtaaatgatatgccaattccaaaatggactgccttgcctgtttacgctcgattttttcttgcgtgatatttgagtattcctgatgatattctaactctaattttggatttctataagtaaaaccaaaatcttcaagttttctttttacttgttctctgtcaaccttccctaagacaaatatatcaattttatccatacgcaacatattccgataaatctgaaaggttgattctgctgtttctttttcaaccaaatcaagcctaccgacgcgtggaatttgaagagagggatctttataaaaaagcttactcatttcaacatctacatgataaaaattatcttctatctctgactgaagaaaattgattaaattcgttttttcaacctcgaaaatctggctatcaaatcctcgcccctttttcagtggtctaaatatacatgtgtataaaaaatcaagaatctccactgtaatatcctcattttctggtaagtgacgaggactgacatatgaaattgtcacatctacacagtgcaccctaccacgtttcgaaactgaggtcgagaactgagcaccatacaattctgccaatcttctccgaacagcctgagcagtctgaaattcttggttacccatttcaaaaatatttgcaactaacacacgaccagcaactgtagcctcactcatttcagctgcaaagcgaatacgtatacgatttgtcgtaaactgatctgtatcaataaaatgaagatctactccctcttgtaatttcatcgtcttcctctttcaaacattgtaccttccattataccattttgtgatataatattctgtaacgaggtgacttatggaatttaaattatttgatgactacatcacattacaagcattgttaaaaacgactggtattctccattcaggaggtgccattaaaggtttcttagaagaaaataccattcttttcaatggagaggatgaaaaaagacgcggtaaaaaaatccgtgtcggagatgttatcacactcccagaccacaacaccagcatcacaatcgtcgctcctagtgcagaggaaatcaaacagcaccaagaggatcaagctgaaaaagaacgtgtggctgcaatcgttaaaaagttaaatcaagaaaataaaaataataagaaacaggtaaaaactcctaaaaaagcaactaaaaagactgaaagaaaacctgttcgtttccctggtatgtagacatgtggctagaacgattagagttacaacattttcgcaattacaaccaattagatattgagttccacaaagggctcaatgtctttttaggcgaaaacgcccaaggaaaaaccaatattctagaatctatctatgttttagccttaacacgaagtcatcgaacacggacagataaggacctactacagtttcaagaaaaggaattatctatttctggtttactccatcgcacaagcggtaaagttccccttgacattcacttgacagacaagggacgagtgaccaaggtcaaccatctcaaacaagccaagctttccaactatatcggccacatgaatgttgttctcttcgcccctgaagatttacagctgataaaaggtgcgcctgctttgagaagaaagttcatcgatgtcgagctcgggcaaatcaagccactctatctctctgacctatcgaattataaccacgttttaaaacaaagaaatacttacctcaaatctacagataagattgatgagaacttcctatctgtgttagatcagcaacttgctgaatatggtagtcgtgttatccaacatcgtattgactttctaaagaaattagaggaattcggaaatagaaaagttcaagaaatatctggcaatcgggaagaattgacaatcgaataccagacctcaatcgaattgacagatgatgtcaatttaattgacaaattcttgacggaactagaaaagtctcgtaaacgtgatttatttaagaaaaatacaggagttggaccacatcgagatgatgtagctttctttataaatggaatgaatgcccattatgctagccaaggtcagcaccgcagtctcgttctgtcactcaaactagctgaaattgagctgatgaaagaagtcacacgagagtacccaattctactcttagatgatgttatgagtgagctggataataatcgtcaaatcaaactattagaaactattacagatacgattcaaacatttattacaacgacatctttagaccatttacataagctacctgatagtttaaaaatcttccatattgagtctggtaaggttactgagtcagaataagattgtttacactatcgtcaataaagtttacaaaaaagtaaagaccctgtcaagagggtcttgcagaacgtagacaaactcctaaaaatataaaaaattgaagaagtttgcgaaagatagcaagttattaaactcttagaaatattgatatttcggcgtttctgagagtttttttattttcaatataaagaaaaaaagattgaagaaaattgtccaaaatggactttttcttcaatctgaaagaccctgccaagagggtcttgtttttgttttactgaactgaatagtttggagcttcgtttgtgatttgaacatcgtgtggatggctttctttcaaaccagcacctgacatttcgatgaattgtgcattttcatgcaattcagtcaagttaccagcacctacatagcccatacctgagcgaagtccaccaaccatttggaaaatcatatctgcaacagaacctttataggctacacgtccttcaattccttctggaacaagtttgttggcttcattgacagatgcttggaagtaacggtcttttgaaccttgtttcatggcagcgatagagcccataccacgataggtcttgaacttacgaccttggaagatttctgtctcacctggtgcttcatcagttcctgcaaacatagaaccaagcataacggcatgaccaccagcggcaagtgccttgacaatatctcctgaatacttgataccaccatcagcgataatcgttttaccatattcacgcgcaacaccagctgcatcatagatagctgtcacttgtggtacaccgacacctgcgataacacgtgttgtacagattgaacctggtccaataccgaccttcacaacatcaacaccagcttcataaagagcacgagctccttcagctgtggcaatgttgccggcaatcaaggtacgagttgggaagtggtcacggatttctttaatcttgcgaagaacgcctgctgagtgaccgtgagctgtatcgatgacaatcgcgtctgcacccgcttcaaaaagggcttctgcacgttcaaaagtatcagatgtaacaccaacagcacccgcaaccaagagacgaccaaattcatccttcgcagcatttgggaactcaatcactttctcaatatctttgatggtaatcaagcctgacaaacgaccattttcatcaaccaatggcaatttttcaatacgatgcttgtgaagaatagcctccgcagtcgcaagatctgttccaactggcgctgtcaccaattcatcgcttgtcatgttggtcgaaattggctgtgagtaatctgaaatgaaacgcatatcgcggttggtgataataccgaccaacttacgattttccaatgtttcaacgattggcacaccggaaatacgataagtagccatcaatttctcagcttcagcaatggtgtgttctggtgttaagaagaatggatcgataatgacaccattttcagaacgttttaccttacgcacctcatctgcctgctccgcgatagacatgttcttatggatgacgcccaaaccacctgcacgcgccatagcgatagccattttgctatctgttactgtatccatggcagcagaaataatcggaagattaagggtcaaatttggtgctaattgtgtttttaaatcaatatcatgtggtaatacatgactttcagccggaataagtaatacatcgtcgaaagtaaagccttttttcaaaaatttagtgtcccagtttgacattttcttcctcttttcttatttaatatgtagcatgattgctatttgtattttaattatgataacattttgaaatcatttgtcaatcattattcgctttaatatcatcattcctaaaaattcagaaaattctattcagtcttatacataaaattcgaacgtttgttttttgctacgtcgtaaaacaaatgaaaaaaacaacattttctcaacattgctctttcattgttaaccttatttaaaatagttgattcccatagcagatttcacttggtcaagagttttcgcagcaacttggcgagctctttggctacctgcttccaacattgcatagacctgtcccatatcctgtgcaaactccagacggcgttcacggattggtcctaattctctctctaaaatgtccagcaaataacgtttggtcttcacatcgcccaaaccaccacgttgatagtgctccttcatagcctcaatctcagccttatcttcttcgcgcccaaagacgtcaagatagtggaaaaccatgtttccttcaatcttacctgggtcttcaacacggatgtggttgggatcagtgtacatggacatgactttcttcttgagcgtatccatgtcatctgccagataaataccatttccaagtgatttagacatcttggcattgccgtccaaacctggcaagcgaccagctgcctcattttcaggataaatgccctccggctctaccaaaatatcagtctggtaagcatggttaaagctacgaacgatttcacgagtctgctcaatcataggtttctggtcatttcctactggaacaaagtttgccttgaaggctgtaatatccgccgcttgtgacacaggatagaccaaaaaaccagctggaattccttcgccaaatcccttctgagcaatctcagtcttcactgtaggattgcgttctagacgtgcaacagataccaagttcatgtagtacatggtcaactctgccaattcaggaatttgactctggatgaaaatcgttgtcttagctggatcaagtcctgccgctagataatctagtgctacgtttccaacggattcaacaatcttttgcggttcctttgcatgatctgtcaacgcttgttggtctgctaaaaagacaaaaagttcatgttgacctgcatcctgtaataaaacacgatttttcaacgaaccaacataatgtccaatatgtaatttgcctgttggacggtctcctgttaggataatcggtttactcataaaatgttctccttttacataataaaagcccacgcacagaaaactgtgcgagggcgtcaaggacacggtgccacctcacttataagcattaaataagcttacatctttttgcacataaggcctgctagccgaatccttatttattcagattctattcactcagtccattcataagcgactcttgtttgtttacaccaaccacaaactctctaaaaattatccacttactactcttctgattgattcctattataaccgcaaaaaattagaaagtcaagctgacaaagccttgacgatactgtctaaattagggataatagaaattgcttttataacactaaccaaggagaatatatgaaagaacgtataaaggactttatctctgtcacactcggatcagttgtcatggccattggatttaacagtttttttctagagaataatatcatatctggtggtgtcggaggtttagcaatcgcactcaatgctcttctgaggtggagtccgtctgattttgtcctctactgtaacatccctttattaatcatctgttggtttttcttaggaaaatctgtatttatcaaaactgtctatggtgctatcatctatcctctttgcatcaagttgacagcaggtttacccaacttgacagaaaatcctctcctagctgctattttcggtggaattatcctaggttttggacttgggcttgtcttccttggaaattcttctactggtggaacaggtattcttattcaatttattcacaagtacacccctttatcattaggtctgacaatggctattattgatggtattatcgttggtcttggatttgttgccttcgatactgatactgttatgtactcgattattgccctaatgaccattacttatattgtcaaccgcatgatgtctggtacccaatcttctcgaaatgtcatgattatttctcaaaaatcagaagaaattaaagactatattactaaagttgctgatcgcggtgtgacagaacttccaattatcggtggctttacaggagttgacaagcgcatgttgatgactaccatctctattccagaaatgcagaaacttgagacagcggtattagaaattgatgaaactgcctttatggttgttatgcctgcgagtcaggtgcgtggacgtggcttcagtcttcaaaaagaccataaacattatgatgaagatattttgattccaatgtaattcattgaaaattcaagttctttctagtacaataaaactaatagacagaaatagaggagaaactatgcttacagtatcagacgtgtcgcttcgctttagcgatcgcaaattatttgacgatgtcaatatcaaatttacagcaggaaatacctacggtttgattggtgcaaacggggccggtaaatctacatttttgaaaattcttgctggtgacatcgagccatcaacaggtcatatttcacttggaccagacgaacgcctttctgtactacgtcagaaccatttcgactatgaagacgaacgcgtcattgacgtagttatcatggggaatgagcaactttacagcatcatgaaagaaaaagatgctatttacatgaaggaagatttttctgatgaagatggtgttcgtgctgctgaattagaaggtgagtttgctgaacttggtggctgggaagctgaaagtgaagcttctcaattgctccaaaacctcaacatttcagaagacctccactaccaaaacatgagcgaattgaccaacggtgagaaggttaaggtcctcttggctaaggcactttttggtaaaccagatgttcttcttttggacgagccaaccaacggtctggacatccaatctatcaactggctcgaagatttcttgattgactttgaaaatacggttatcgtcgtgtcacacgaccgccacttcttaaacaaagtatgtacccatatggccgaccttgacttcggtaaaatcaagattttcgttggtaactatgacttctggaaacaatctagcgaactagcagctaaactacaagctgaccgtaatgcaaaagcagaagaaaaaatcaaagaactacaagaattcgttgcccgtttctctgctaatgcttctaagtctaagcaagctacttcacgtaagaaaatgttggacaaaatcgagttggaagaaatcattccttctagccgtaagtatccatttatcaacttcaaatcagaacgtgaaatcggtaatgacctcttaacagttgaaaacttgaaagttgttattgatggtgaaacgattcttgacaatatcagctttatcctgcgcccaggtgacaagactgctcttattggtcaaaacgacatccaaacaactgctctcattcgtgctcttatgggcgatattgaatatgaaggtactgtcaagtggggtgtcactactagtcaatcctacttaccaaaagacaatactcgtgactttgatacaaacgaatctatccttgattggctccgtcaatttgccagcaaggaagaagatgacaataccttcttgcgcggtttcttgggacgtatgctcttctcgggtgatgaggttaacaaacctgtaaacgtcttgtcagggggcgaaaaagtgcgcgtgatgttgtcaaaactcatgctcctcaagtcaaatgtcttggtcttagatgatccaaccaaccacttggacttggaatcaatttccagtctgaacgatggtttgaaagcttttaaagagtccatcatctttgccagccatgaccacgaatttattcaaactttagcaaaccatatcatcgtcatttctaaaaacggtgttatcgaccgaatcgacgaaacttatgatgaattcttggaaaatgctgaagtacaagcaaaagtacaagaactttggaaagcataataaaaagaggctgggacttttgcccagcctctcttctcagagttcgtgtcaacatctcagcgcagtggttgattgccagatttgttcgtgtttcacactccaaatctggccattacgactgttgcgaacaaagttcgccttatctccaacctcaaactgtctcccagacagtttgagctgtgcgggggtgggagtgaaacagtctgggaatagactgtttcagctcaacaactagaaataaagacttgttgacgaactcttttttgaccggtcaagttctttcccacttccttttcttttaaatctatgaaaaaaatatttacaaaaacatccatttattatctcttatctttccttattccgctgactattatttctatcgtcttagcatttcaaggaatctggtggggaagtgatacaacaatattggccagtgatggtttccatcagtatgttatttttaatcaaacattacgaaatactttacacggagacggctctttattttacacattttcaagtggtttaggactcaatttttatgctctatcctcctattacctaggttcattcctatctccaattgtctttttctttgatttacaatccatgcctgacgctatctaccttgtcactattgtcaaatttggattgactgggttgtcaacttatttcagtctaaagggtatccataaaaatttgaaagaagaatgggcactattactcgctactagtttttctctgatgagttttagtacaagtcaattagaaataaacaactggctagacgtttttatactcctcccactcgttcttcttggattgcatcgattattaaaaaaacagggtccgattctctactacataacattaacatgcttgtttatccaaaactattacttcggttatatggtggctatttttctaacattatggacattggttcaattatcatggatagatagtcagagaatcaaaagatttatcaactttacaatagtgtcaattttatctgctctaagcagcatgttcatgttgttaccaacctacttggatttaaaaactcatggtgagacatttacaaaaattgtcaacctaaaaaccgaagactcttggtatctggacttctttgcaaaaaacttagttggtagctttgatacaacaaaattcggttctattcccatgatctctgttggtctcgttccattaatactcgctttattattctttacattaaaagaaataaaaccaactgtcaaactctcctatgctctattctttacattcattatttcaagtttctacctacaaccactcaatcttttttggcaaggtatgcatgcgccaaacatgttcctctatcgttatgcatgggctctatcaataaccgttatctatttagcagcagagacattggtacgactacgtcaagtaagtattaaaaattttactctgattgtttcatttttactcatttgctttacttctacctttatttttagagatcattatgagtttctaacggatgtaaatttcctactcacactagaatttctaatagcctacttcattctttttgtagcaatgattcgctataaatcatccttaaaatggattaatattgttttattgttcttcactttcttagaacttggattacatagtcattatcaggttcaggggatttctgatgaatggcattttcctagccgatcaaactatgaagaaaaattgacagatattgacagtattgtaaagtctacaaagactacaactgattcattttatcgtatagaacgtctattaccacaaactggcaatgatagcatgaaattcaattacaacggtatttctcaattctcctccattcgaaatcgtgcttccagctcagtactagataagctcggtttccgttcagatggtaccaatttgaatcttcgctatcagaataatacaatcattgctgatagcctattcggagtcaaatataatttagctactacggacccaaataagtttggtttcacactgaatcagagtcagtctactattaatctttacgaaaatagttttaatctagggttagccctattgactgaagggatttacaaagatgtcaattttacaaatctgactctcgataatcaaacaaattttcttaatcaactaacagggctatctcaaaaatactaccacactttatcagatgttgtttcacaaaatacagttgaactgagcaatcgaatgactgtcaacaaagtggacaatgaggatgctgcaaaagcaactttcttagtaaatatacctgcaaatagccaagtatacttaaatttgccaaatttaacattctcaaatgagaatcaaaaaaaagttgtcattactgtcaacaatcagtcaagtgagtttacactagataatgctttctctttcttcaatgtggggagctttactacagatgtacaggttcaagtcaatgtatattttcctgaaaataatcaagtttcttttgataaaccacaattttatcgattggacttattagctttccaacaggctatttccattctccaagaaaaacaagtagtaacaaaaactgatggtaataaagtaactgttgattttgtaaccgataaagaatcctcactcctccttactttaccctatgataaaggatggaatgcaaccattgatggtaaacctatcaaaatccaaaaagcgcaagatggttttatgaaagtggatgtaagtccaggtcaaactaaactagttttaacctttgtaccaaatggtttctatctaggtttactgatttcttttggtgcagtttttgtatttttctcctatcaattcattggatactattattctaagaaccgagaatactaaactttctcggttttttcttgtaaaaaacaaaaaaccttgatttctcaaggtttcctatgctttatctactccgccaacagggctcgaacctgtgacatcatgattaacagtcatgcgctctaccaactgagctatggcggaagaaatagtccgtacgggattcgaacccgtgttaccgccgtgaaaaggcggtgtcttaaccccttgaccaacggaccatttttagaacaataactagtataatacatgtgactttgtttgtcaatacattttttgattttttattgtattgacagagtgctttgtttaatgtaaaataaaatggttaaggttccatagctcagctggatagagcattcgccttctaagcgaacggtcgcaggttcgaatcctgctggaatcatttagacctacctcgagtaggtcttttttcttgccataattcataattaatatataacactggcaaaatcagaccaataagggcatattcttcaaattggaaggataggtgagtagatatgatgacacctagcataaaccctataatggtcaataagatgtttctacctgtttttctaagttctgaatctttttcaataactcctttaaaccagagataagcagcatttttgacattccctgtcatcatcacattggcatacggagcacctcgtaaccttctaaatgtttctacttgaatagaggctacgaaggctagactagcaattgtaaaagacgcaggcattataggtgagagaatgatagttagtaaaataagaactaacatcattacactactaccaaagtgccaagaccatgtttgtttttcaaaataccttcttgctaagtaggtaaaaaattgtccgaatacaaaaaataaaatgggaatggaaaaattaactacctgcgcaaaatcacctttagctaaaaaataagctagggaaataacatttccagattgtacgccagcaaagcgaccaccctgagtcacaaaagtaaaggcatttaaataaccactgataaacgttaatgaacaagcaattctcaatccctcaaaaacacgatactctttttgattcattttcactccttgtttcacgtgaaactacttatgatatgggcttccctgctgaatcataaatgcacgataaatctgctcgatgaaaactaatttcattagttgatggggaagtgtcaactgtccaaaactcatcaacaaattagctctttttttaatacaagaatcgagacccaaactaccaccgatgataaaagttatatctgaatacccatttactgcaatgtcagatatcctttgactaaattcttccgatggaaattgtttcccttctatcgctaaggcaatgacaaaatctcgctctccaattttagacataattctatcggcttctttttttaatatttgttcattctctgcctgactggctttatctggtgttttttcatcaggaagctcaatcatatccaacttagtaaatcgtcccaatcgtttactatattctgcaataccttctttgaggtacttttctttcaattttccaacggtaatcaattttattttcataaaataattgtaacatatccacaagcatacgacagaaaatatttttagaaaatcaggatatggctacagtttttcacataattcacagagttatccacaggttgtggattgatttttgaaaactttaagttataattaagaaagaaatagtactcttaaggaaaattaaagaaatggaaaggattccttatatgaaaaaatatttgaaatttgcgattttatttgtaattggattttttgggggtcttatcggggccttgtcagcctctttcttccagccacaggtgcaacaagcaaattctgctatcactagtgtcagcaatgttcaatataataatgaaacttccaccacaaaagctgtagagaaagtacaaaatgctgttgtgtctgttattaattaccaaaaatcagccaacaatagtcttggtgttatctttggaaatattgaatcatctgacgaactagctgttgctggagaggggtctggggttatctataaaaaatatggtcaatatgcctatattgtgacaaatacgcatgttattaataacgcagaaaagattgatatccttttagcatctggagaaaaaattagcggtgaacttgttggttccgatacatattctgatatagctgttataaaaatatcagcagataaagtcactgctgttgctgaatttgctgattccgatacaattaaagttggagaaactgctatcgcaattggtagtcctctaggtagcgtctacgccaatacagttacccagggtattatttctagcttaagtcggacagttacttcacaatcaaaagatggacaaacaatctcaactaacgctattcaaactgatacagctatcaaccctggaaactctggcggaccgttaatcaatacccaaggacaagtgataggcattacctctagcaaaattacctcaagttctgcaaatagctcaggcgtggctgtagaagggttgggatttgctattcctgcaaatgatgccgtagctattatcaatcagcttgaaaaaactggacaagttagccgacctgctcttggagttcatatggttaacttgacgaccttgtcaactagtcaattagaaaaagctggattatcaaatacggaattaacatccggtgtagtaattgtctctacacaaagtgggctacctgcagatggaaaattagaaacttttgatgttattactgagattgacggagaagctattcaaaataagagtgacctccagagcgctctctacaaacatcaaattggagatacaatcactgtaacttattaccgcaataatcagaaacaaactgttgacattaagttgacacattctacagaagaacttagcgaataattgacaaatgagactttacacaattgtaaagtctcattttttttgctagaataaggatatatggaagaattacgtacactaaatatttcagaaatccatcccaatccctatcagccaagaattcattttgatgaaaaggagctacttgagctcgctcaatctattaaggaaaatggcttaattcaaccgattattgtaagaaaatcttctattatcggatacgaattattagctggagaaagaaggttgcgagccagtcaattagctggactgactacaataccagcagtggtaaaagaactgactgatgatgatttactctatcaggctatcatagagaatctgcagcgttctaacttaaatccgatagaagaagcagcctcttatcaaaaattgattagtagagggttaacacatgatgaagttgctcaaatcatgggaaaatcaagaccatatatcagtaatttattgcgcctactaaatctatcatctcagactaaacaagctgtagaagaaggaaaaatttcacaagggcacgcgcgacaattggtgtcattttcagaagaaaagcaagccgaatgggttcaactcattttatcaaaggatttaagtgtgcgtacgcttgaaaaattaatagctgcaaataagaaaaaacacactaagcttaaacaacgcgaccaatttttaaaagaacaggaagattcactcagtaaaactcttggaacagctacaaaaattatcaagaagaaaaacgggagcggagaaattcggattagctttaatgacctcgatgaattcgaaagaattatcaacaattttaaatagacttgtttacaatttatttttataaacactcttttccacactaaaatcattacaaaaagtcaggaccagcaagggttctgacttttattcacatcttgtggaaaatttttcttaacagtgtggattttaaaaattatctgtggaaaacttttgttttttatggtacactattctaacgaatataatgtgaaagggggaaaat
